US009321829B2

(12) United States Patent
Ahmed et al.

(10) Patent No.: US 9,321,829 B2
(45) Date of Patent: Apr. 26, 2016

(54) ANTIBODIES DIRECTED AGAINST INFLUENZA

(71) Applicants: Rafi Ahmed, Atlanta, GA (US); Jens Wrammert, Decatur, GA (US); Patrick C. Wilson, Chicago, IL (US)

(72) Inventors: Rafi Ahmed, Atlanta, GA (US); Jens Wrammert, Decatur, GA (US); Patrick C. Wilson, Chicago, IL (US)

(73) Assignee: Emory University, Atlanta, GA (US)

( * ) Notice: Subject to any disclaimer, the term of this patent is extended or adjusted under 35 U.S.C. 154(b) by 0 days.

(21) Appl. No.: 14/350,632

(22) PCT Filed: Oct. 18, 2012

(86) PCT No.: PCT/US2012/060912
§ 371 (c)(1),
(2) Date: Apr. 9, 2014

(87) PCT Pub. No.: WO2013/059524
PCT Pub. Date: Apr. 25, 2013

(65) Prior Publication Data
US 2014/0348851 A1 Nov. 27, 2014

Related U.S. Application Data

(60) Provisional application No. 61/548,704, filed on Oct. 18, 2011, provisional application No. 61/603,895, filed on Feb. 27, 2012.

(51) Int. Cl.
*C07K 14/00* (2006.01)
*C07K 16/10* (2006.01)
*G01N 33/569* (2006.01)

(52) U.S. Cl.
CPC ...... *C07K 16/1018* (2013.01); *G01N 33/56983* (2013.01); *C07K 2317/33* (2013.01); *C07K 2317/76* (2013.01); *G01N 2469/00* (2013.01)

(58) Field of Classification Search
None
See application file for complete search history.

(56) References Cited

U.S. PATENT DOCUMENTS

| 5,684,146 | A | 11/1997 | Okuno et al. |
| 2002/0054882 | A1 | 5/2002 | Okuno et al. |
| 2009/0311265 | A1 | 12/2009 | Van Den Brink et al. |
| 2012/0282273 | A1 | 11/2012 | Wrammert et al. |
| 2014/0046039 | A1 | 2/2014 | Ahmed et al. |

FOREIGN PATENT DOCUMENTS

| EP | 10822829.7 | 12/2010 |
| WO | WO 2008/028946 A2 | 3/2008 |
| WO | WO 2009/115972 A1 | 9/2009 |
| WO | WO 2010/010466 | * 1/2010 ............ C07K 16/00 |
| WO | WO 2011/044570 | 10/2010 |
| WO | WO 2010/130636 | 11/2010 |

OTHER PUBLICATIONS

MMWR Dispatch 2009; 58:1-3. Available at: http:www.cdc.gov/mmwr/preview/mmwrhtml/mm58d0421a1.htm).
Ahmed, et al., 2007, Protective immunity and susceptibility to infectious diseases: lessons from the 1918 influenza pandemic. Nat Immunol, 8(11), 1188-1193.
Brockwell-Staats, et al., 2009, Diversity of Influenza Viruses in Swine and the Emergence of a Novel Human Pandemic Influenza A (H1N1). Influenza Other Respi Viruses 3(5), 207-213.
Chiu, et al., 2013, "Cross-reactive humoral responses to influenza and their implications for a universal vaccine", Ann N Y Acad Sci, 1283:13-21.
Compans, R.W., 1974, "Hemagglutination-inhibition: rapid assay for neuraminic acid containing Viruses", J Virol 14(5), 1307-1309.
Dawood, et al., 2009, "Emergence of a novel swine-origin influenza A (R1N1) virus in humans", N Engl J Med, 360 (25):2605-2615.
Garten, et al., 2009, "Antigenic and genetic characteristics of swine-origin 2009 A(H1N1) influenza viruses circulating in humans", Science, 325(5937), I97-201.
Hancock, et al., 2009, "Cross-Reactive Antibody Responses to the 2009 Pandemic H1N1 Influenza Virus", N Engl J Med, 361(20): 1945-1952.
Kubota-Koketsu, et al., 2009, "Broad neutralizing human monoclonal antibodies against influenza virus from vaccinated healthy donors", Biochem Biophys Res Commun, 387(1): 180-185.
Li, et al., 2012, "Pandemic H1N1 influenza vaccine induces a recall response in humans that favors broadly cross-reactive memory B cells", Proc Natl Acad Sci U S A, 109(23):9047-9052.
Nakajima, et al., 1983, "Identification of the binding sites to monoclonal antibodies on A/USSR/90/77 (H1N1) hemagglutinin and their involvement in antigenic drift in H1N1 influenza viruses", Virology, 131(1): 116-127.
Nakaya, et al., 2011, "Systems biology of vaccination for seasonal influenza in humans", Nat Immunol, 12 (8):786-795.
Sheerar, et al., 1989, "Antigenic conservation of H1N1 swine influenza viruses", J Gen Virol, 70(12): 3297-3304.
Smith, et al., 2009, "Rapid generation of fully human monoclonal antibodies specific to a vaccinating antigen", Nat Protoc, 4(3):372-384.
Throsby, et al., 2008, "Heterosubtypic neutralizing monoclonal antibodies cross-protective against H5N1 and H1N1 recovered from human IgM+ memory B cells", PLos One, 3(12): e3942.
Vareckova, et al., 2002, "Evaluation of the subtype specificity of monoclonal antibodies raised against H1 and H3 subtypes of human influenza A virus hemagglutinins", J Clin Microbiol, 40(6): 2220-2223.
Wentworth et al, 1994, "An influenza A (H1N1) virus, closely related to swine influenza virus, responsible for a fatal case of human influenza", J Virol, 68(4): 2051-2058.

(Continued)

*Primary Examiner* — Michelle S Horning
(74) *Attorney, Agent, or Firm* — Emory Patent Group

(57) ABSTRACT

Antibodies that specifically bind influenza virus hemagglutinin A (HA), and antigen binding fragments thereof are disclosed herein. In several embodiments, these antibodies are broadly neutralizing. Nucleic acids encoding these monoclonal antibodies, vectors including these nucleic acids, and host cells transformed with these vectors are also disclosed. Compositions are disclosed that include these antibodies, antigen binding fragments, nucleic acids, vectors and host cells. Method of using these antibodies, and antigen binding fragments, nucleic acids, vectors and host cells, such as for diagnosis and treatment of an influenza virus infection are also provided.

11 Claims, 90 Drawing Sheets

(56) References Cited

OTHER PUBLICATIONS

Wrammert et al., 2008, "Rapid cloning of high-affinity human monoclonal antibodies against influenza virus", Nature, 453(7915):667-671.

Wrammert, et al., 2011, "Broadly cross-reactive antibodies dominate the human B cell response against 2009 pandemic H1N1 influenza virus infection", J Exp Med, 208(I): 181-193.

Yamashita, et al., 2010, "Highly conserved sequences for human neutralization epitope on hemagglutinin of influenza A viruses H3N2, H1N1 and H5N1: Implication for human monoclonal antibody recognition", Biochem Biophys Res Commun, 393(4): 614-618.

Yoshida, et al., 2008, "Cross-protective potential of a novel monoclonal antibody directed against antigenic site B of the hemagglutinin of influenza A viruses", PLos Pathog, 5(3), e1000350.

European Search Opinion, dated Sep. 8, 2013, for to European Patent Application 10822829.7 filed Dec. 10, 2010.

Supplementary Search Report, dated Sep. 8, 2013, for European Patent Application 10822829.7 filed Dec. 10, 2010.

International Search Report, dated Sep. 29, 2013 for international publication No. WO2011/044570 filed Oct. 12, 2012.

Supplemental information from Wrammert et al., 2008, "Rapid cloning of high-affinity human monoclonal antibodies against influenza virus", Nature, 453(7915):667-671.

Wilson, Gene Bank Accession No. FJ475055, Cloning vector AbVec-hIgG1, Antibody variable gene expression vector for human IgG1 heavy chain, 2008.

Sui et al. Structural and functional bases for broad-spectrum neutralization of avian and human influenza A viruses, 2009, Nature Structural & Molecular Biology 16(3):265.

Database UniParc [Online] Jun. 2012 (Jun. 4, 2012), XP002738233, Database accession No. UPI000264068E.

Database UniParc [Online] Jun. 4, 2012, XP002738234, Database accession No. UPI000264068D.

Ohshima et al., Naturally Occurring Antibodies in Humans Can Neutralize a Variety of Influenza Virus Strains, Including H3, H1, H2, and H5, Journal of Virology, 2011, 85(21):11048-11057.

Zhang et al. Determination of serum neutralization antibodies against seasonal influenza A strain H3N2 and the emerging strains 2009 H1N1 and avian H5N1, 2010, Scand J Infect Dis, 43(3):216-20.

\* cited by examiner

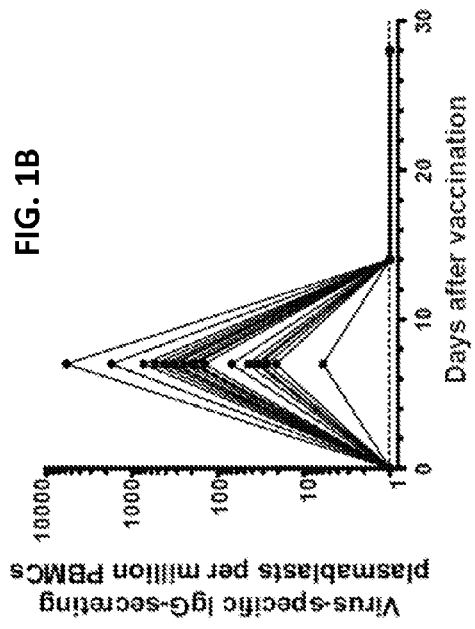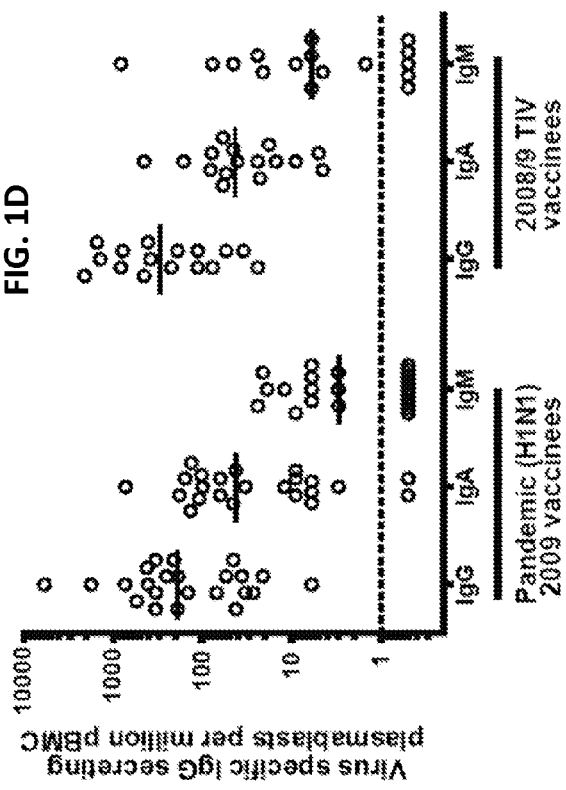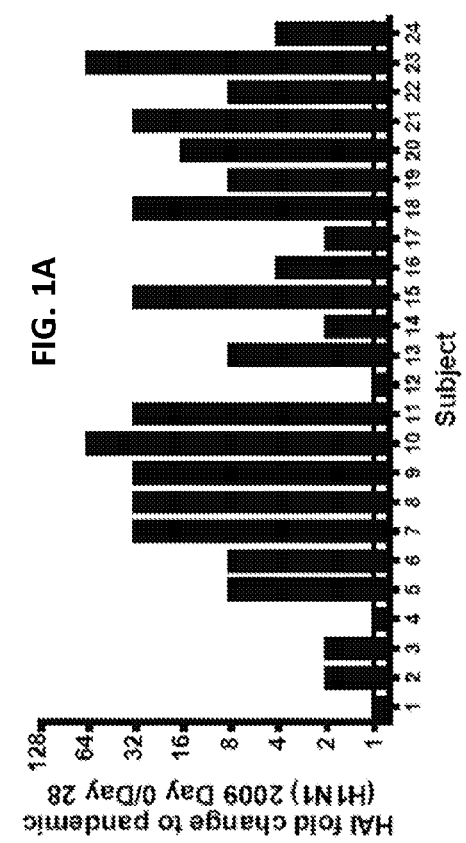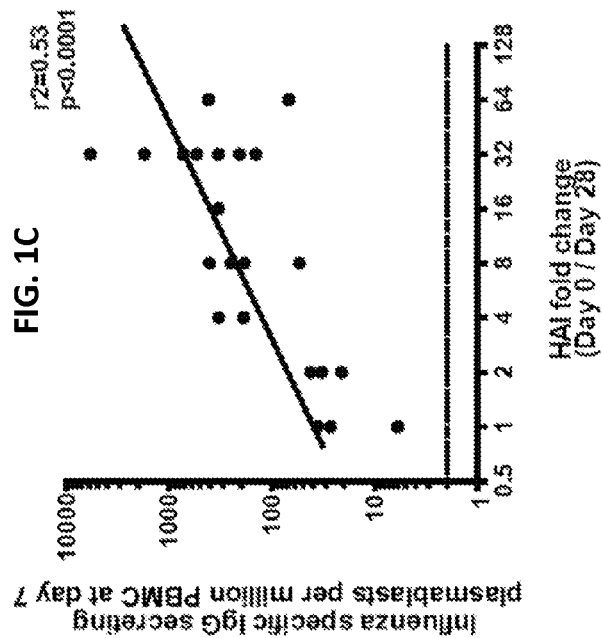

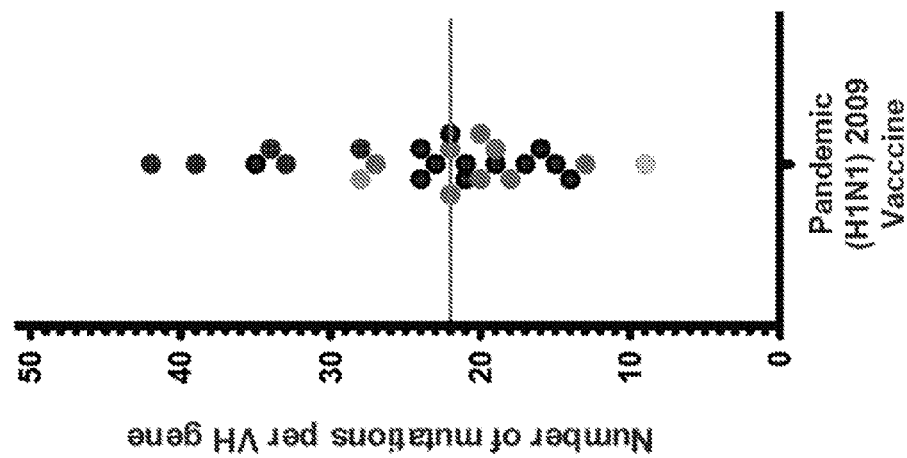
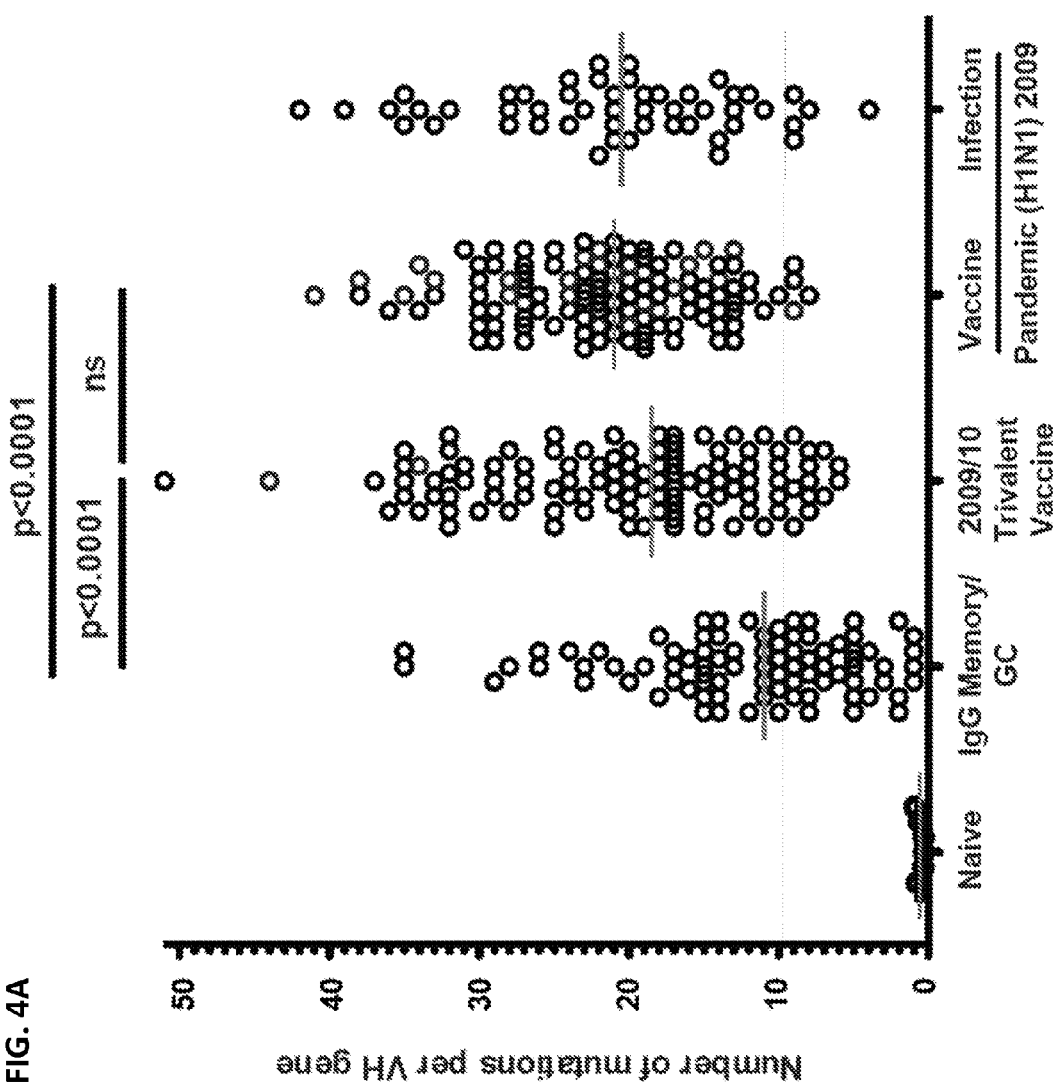
FIG. 4B
FIG. 4A

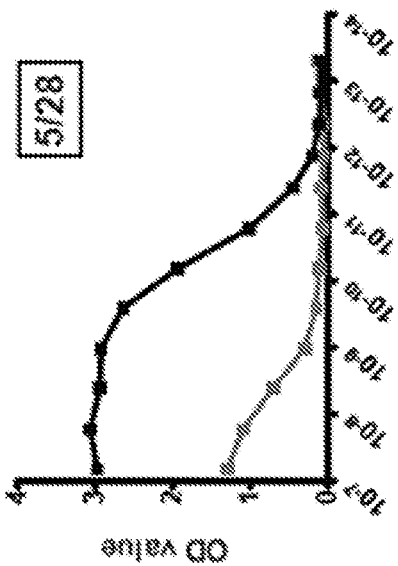
FIG. 10C mAb 015-2D02
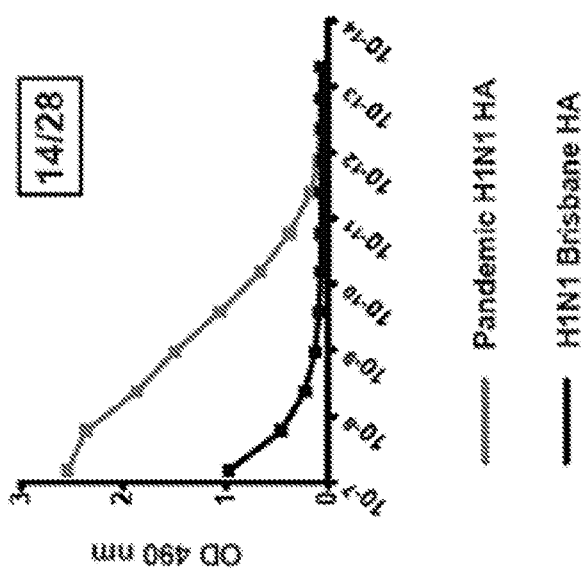
FIG. 10B mAb 009-2G01
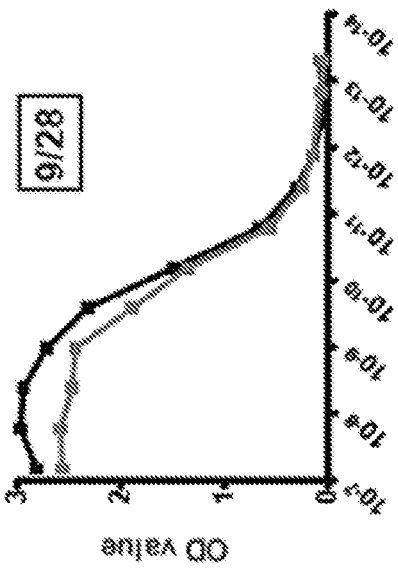
FIG. 10A mAb 019-2A02

FIG. 12

| Row | Name | V-REGION (1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
|---|---|---|---|---|---|---|---|---|---|---|---|
| 2 | 005-2G02H | QVQLVQSGP EVKKPGASIK VSCRASGYT FSNYGITWV RQAPGQGLE WMGWISAYN GHTNSAQKF QGRVTMTD TSTSTAYME VRSLRSDDT AVYYCAR (SEQ ID NO: 1) | QVQL VQSG PEVK KPGA SIKVS CRAS S (SEQ ID NO: 2) | GYTFS NYG (SEQ ID NO: 3) | ITWVR QAPGQ GLEWM GW (SEQ ID NO: 4) | ISAYNG HT (SEQ ID NO: 5) | NSAQK FQGRV TMTTD TSTSTA YMEVR SLRSD DTAVY YC (SEQ ID NO: 6) | ARDR RDLLT GSLG DY (SEQ ID NO: 7) | caggtgcagctgtgtcagtctgacctgag gtgaagaagcctggggcctcaattaaggtct cctgcagggcttcaggatacacctttcaatt atggaatcacctgggtgcgacaggcccctg gacaagggcttgagtggatgggctggatca gcgctacaatgtcacacaaattctgcaca gaagtccaggggagagtcaccatgacca cagacacatccacgacacgcctacatg gaggtgaggagcctcagatctgacgacac ggccgtatattactgtgcgagacagaag ggatcttttgactggttcgttgggactactg gggccaaggaaccctggtcaccgtctcctc ag (SEQ ID NO: 8) | QVQLVQSGPE VKKPGASIKVS CRASGYTFSN YGITWVRQAP GQGLEWMGWI SAYNGHTNSA QKFQGRVTMT TDTSTSTAYME VRSLRSDDTAV YYCARDRRDLL TGSLGDYWGQ GTLVTVSS (SEQ ID NO: 9) | WGQ GTLV TVSS (SEQ ID NO: 10) |
| 3 | 005-2G02L | DVVMTQSPL SLPVTLGQP ASISCRSSRG LLYIDGNTYL NWFQQRPG QSPRRLIHNV SNRDSGVPD RFSGSGSRT DFTLKISRVE AEDVGVYYC MQGTYW (SEQ ID NO: 11) | DVVM TQSP LSLP VTLG QPAS ISCR SS (SEQ ID NO: 12) | RGLLYI DGNTY (SEQ ID NO: 13) | LNWFQ QRPGQ SPRRLI H (SEQ ID NO: 14) | NVS (SEQ ID NO: 15) | NRDSG VPDRF SGSGS RTDFTL KISRVE AEDVG VYYC (SEQ ID NO: 16) | MQGT YWPF T (SEQ ID NO: 17) | gatgtgtgatgactcagtctccactctccctg ccgtcacccttgacagccggcctcatct cctgcagttcgtagtcgagcctccttatattg atggaaacaccttacttgaattgtttcaacag aggccagcaatctccaaggcgcctaatt cataacgtttctaacaggactcgggtccc agacagattcacactcagcggcagtgggtcacgca ctgatttcacactgaaaatacagcaggtga ggctgaagatgtgggttattactgcatgca agtacatactgccgttcacttttgcagg ggaccaaggtggaaatcaaac (SEQ ID NO: 18) | DVVMTQSPLSL PVTLGQPASIS CRSSRGLLYID GNTYLNWFQQ RPGQSPRRLIH NVSNRDSGVP DRFSGSGSRT DFTLKISRVEA EDVGVYYCMQ GTYWPFTFGQ GTKVEIK (SEQ ID NO: 19) | FGQG TKVEI K (SEQ ID NO: 20) |

FIG. 12 (continued)

| Row | Name | V-REGION (1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
|---|---|---|---|---|---|---|---|---|---|---|---|
| 6 | 029-3401H | RLQLQESGPGL VKPSETLSLTC TVSGGSITSNT YYWGWIRQPP GKGLESIGSISF SGRTYYSVDTSK NQFSLKLSSVT AADTAFYYCAR (SEQ ID NO: 41) | RLQLQ ESGPG LVKPSE TLSLTC TVS (SEQ ID NO: 42) | GGSITS NTYY (SEQ ID NO: 43) | WGWIR QPPGK GLESIG S (SEQ ID NO: 44) | ISFSGRT (SEQ ID NO: 45) | YYSPSL KSRVT MSVDT SKNQF SLKLSS VTAADT AFYYC (SEQ ID NO: 46) | ARQLT GMVYAI LLPSYF DF (SEQ ID NO: 47) | cggctgcagctgcaggagtcgggcccagga kptcgaagcctcgctgagcctgtcctgc actggctcgctgtgtctgatcgccaccagtaa cacttactactactggggctggatccgccagcccc caggaaggggctggagtggattggaagtat ctctttagtggtgaactactacagccgtc cctcaagagtcgagaccactagtcagtga acagcccaaagcgcgcgccaccggcttattt actgtgcgagaacgttcctgactctctgagc gtactcttcttacgctccatgtcactgtgagc caggagacccgtgactgtaccgtctcctcag (SEQ ID NO: 48) | RLQLQESGPGLV KPSETLSLTCTVS GGSITSNTYYWG WIRQPPGKGLES IGSISFSGRTYYS PSLKSRVTMSVD TSKNQFSLKLSS VTAADTAFYYCA RQLTGMVYAILLP SYFDFWGQGT LVTVSS (SEQ ID NO: 49) | WGQG TLVTV SS (SEQ ID NO: 50) |
| 7 | 029-3201L | DIQMTQSPSTL SASVGDRVTIT CRASQSIGSWL AWYQQKPGKA PKLLIYKASTLE SGVPSRFSGS GSGTEFTLTISS LQPDDLATYYC QQHNSY (SEQ ID NO: 51) | DIQMTQ SPSTLS ASVGD RVTITC RAS (SEQ ID NO: 52) | QSIGS W (SEQ ID NO: 53) | LAWYQ QKPGK APKLLI Y (SEQ ID NO: 54) | KAS (SEQ ID NO: 55) | TLESGV PSRFS GSGSG TEFTLTI SSLQP DDLATY YC (SEQ ID NO: 56) | QQHNS YSGA (SEQ ID NO: 57) | caggtgcagctggtgcagtctgggggagg gaggagccgagggtcctgcgtgacagctctc tgaaggctctggttgaggtctttcaccagcttc ggatcagcggggtgcggacagccccgggac tattttgctaccacaagtaccgcaagaagtt ccagggcagactcaccattaccgcgggacaa agcgacgaagtccgacagaggccgtgacga cgtgcgagcggactggagtttatgaattgggcc cgcacacggagaccacctgaccgtctcctcag (SEQ ID NO: 58) | QVQLVQSSAEVK RPGSSVTVSCKA SGGSFTSFVISW VRQAPGQGLEW MGGVIFFATPKY AQKFQGRLTITA DKSTNTAYMELT SLRSEDTAMYYC ASPDLTWVFVPH TGPLDFWGQGT LVTVSS (SEQ ID NO: 59) | FGSQGT KVEIK (SEQ ID NO: 60) |

FIG. 12 (continued)

| Row | Name | V-REGION(1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
|---|---|---|---|---|---|---|---|---|---|---|---|
| 8 | 005-1C02H | QVQLVESGAEV KKPGSSVRVSC KLSGGTFSTHG INWVRQAPGQ GLEWMGGIIPIF GSAKYAQKFQ DRVTITADEST RTAYMEVTRLR SEDTATIYCA (SEQ ID NO: 61) | QVQLV ESGAE VKKPG SSVRV SCKLS (SEQ ID NO: 62) | GGTFS THG (SEQ ID NO: 63) | INWVR QAPGQ GLEWM GG (SEQ ID NO: 64) | IIPIFGSA (SEQ ID NO: 65) | KYAQK FQDRV TITADE STRTAY MEVTR LRSEDT ATIYC (SEQ ID NO: 66) | AGGSD DHAWG SFY (SEQ ID NO: 67) | caggtgcagctggtggagtctggggctgagg tgaagaagcctggggtcctcggtgagggtctc tgtaaactctggaggcaccttcagcacccat ggtatcaactgggtgcgacaggcccctgga caaggctggagtggatggaggatatc ctattggttcagcagatacgataccgcggac atccacgaggacagctacctacgatgggac ccgcctgcgatctgaggacacggctgtgtatt actgtgcgggaggatcgatcatgcttg gggagttttactggggccagggaaccccg gtcaccgttcctgcagtctcaccactggggccc atggtcttccatcagtctgggaggacctggctg cctggtcaaggacttactttccccgagaacggtga cggtcg (SEQ ID NO: 68) | QVQLVESGAEVK KPGSSVRVSCKL SGGTFSTHGINW VRQAPGQGLEW MGGIIPIFGSAKY AQKFQDRVTITA DESTRTAYMEVT RLRSEDTATIYCA GGSDDHAWGSF YWGQGTPVTVS S (SEQ ID NO: 69) | WGQG TPVTV SS (SEQ ID NO: 70) |
| 9 | 005-1C02K | DIVMTQTPLSLP VTPGEPASISC RSSQSLXDSDD GNTSLDWYLQ KAGSPQLLIY TLSYRASGVPD RFSGSGSGTDF TLKISRVEAEDV GVYYCMQRIAF (SEQ ID NO: 71) | DIVMTQ TPLSLP VTPGE PASISC RSS (SEQ ID NO: 72) | QSLXD SDDGM TS (SEQ ID NO: 73) | LDWYL QKAGQ SPQLLI Y (SEQ ID NO: 74) | TLS (SEQ ID NO: 75) | VRASG VPDRF SGSGS GTDFTL KISRVE AEDVG VYYC (SEQ ID NO: 76) | MQRIAF PFT (SEQ ID NO: 77) | gatattgtgatgactcagactccactcctcctg ccgtcaacccctggagagccggcctcatcttc tgcaggttctagtcaaaccctttggacggactcgt atgatgaaacaccttttgactggtacctgc agaagccagggcagtctccacagctcctgat ctatacgttatcctatcggcctctgagtccca gacaggttcagtggcagtggatcaggcacg gattcacactgaaatcagaggtggaggct gaggatgttggggtttattactgcatgcaacgt atagcttcatccccgccactgatgccgcagt atcgtctttcatctccgccatcgatgccgcagt tgaaatcgaagtcgcctctgttcgtgtgctgct gaatactctcatccagatgaagccctccaa cagggaggatggaataacgaactccaa (SEQ ID NO: 78) | DIVMTQTPLSLPV TPGEPASISCRSS SQSLXDSDDGNT SLDWYLQKAGQ SPQLLIYTLSYRA SGVPDRFSGSGS GTDFTLKISRVE AEDVGVYYCMQ RIAFPFTFGQGT KLEIK (SEQ ID NO: 79) | FGQGT KLEIK (SEQ ID NO: 80) |

FIG. 12 (continued)

| Row | Name | V-REGION (1) | FR1 IMGT | CDR1 IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 10 | 005-1003H | QVQLVQSGAEVKKPGESLKISCRAYEYTFTAFCVGWVRQMPGTGLEWMGICPGDSDLKYSPSFQGQVTISADKSITTAYLQWSSLKASDTATYYCARHVASHWGDY (SEQ ID NO: 81) | QVQLVQSGAEVKKPGESLKISCRAY (SEQ ID NO: 82) | EYTFTAFC (SEQ ID NO: 83) | VGWVRQMPGTGLEWMGI (SEQ ID NO: 84) | ICPGDSDL (SEQ ID NO: 85) | KYSPSFQGQVTISADKSITTAYLQWSSLKASDTATYYC (SEQ ID NO: 86) | RHVASHWGDYVGMDL (SEQ ID NO: 87) | caggtgcagctggtgcagtctggggctgaggtgaaaaagcccggggagtctctgaagatctcctgtaaggtttctggatacacattcactgcattctgctgtgtgcgccagatgcccgggaaaaggcctggagtggatgggaatctgcccgggatctgatctaaaatacagtccgtcattccagggccaagtcaccatcaccgctgactcaatcaccacgctacctacagtggagcagcctgaaggcctcggacaccgccacatattactgtgcgagacatgtgcaagtcagttggggatcgtcggtatggggacaggggccaagggaccacggtcaccgtctcctcagga (SEQ ID NO: 88) | QVQLVQSGAEVKKPGESLKISCRAYEYTFTAFCVGWVRQMPGTGLEWMGICPGDSDLKYSPSFQGQVTISADKSITTAYLQWSSLKASDTATYYCARHVASHWGDYVGMDLWGQGPRSASRQHPPRLRMCSPSYQGADTPLGAQRPWAAWSRTTSPMR (SEQ ID NO: 89) | WGQGTSVSVSS (SEQ ID NO: 90) |
| 11 | 005-1003L | EIVLTQSPGTLSVSPGERVTLSCRASQSVTRNLAWYQQRPGQAPRLLIYSASTRAIGIPVRFSGRGSGTDFTLSISSLQSEDSAVYCQQYNDW (SEQ ID NO: 91) | EIVLTQSPGTLSVSPGERVTLSCRAS (SEQ ID NO: 92) | QSVTRN (SEQ ID NO: 93) | LAWYQQRPGQAPRLLIY (SEQ ID NO: 94) | SAS (SEQ ID NO: 95) | TRAIGIPVRFSGRGSGTDFTLSISSLQSEDSAVYC (SEQ ID NO: 96) | QQYNDWLGGT (SEQ ID NO: 97) | gaaattgtgttgacgcagtctccaggcaccctgtctgtgtctccaggggaaagagccaccctctcctgcagggccagtcaaagtgttaccagaaacttagcctggtaccagcagagacctggccaggctcccaggctcctcatctatggtgcatccaccagggccactggtatcccagtcaggttcagtggcagtgggtctgggacagacttcactctcaccatcagcagactggagcctgaagattttgcagtttattactgtcaacagtataataactggctaggtggaacgttcggccaagggaccaaggtggaaatcaaacgg (SEQ ID NO: 98) | EIVLTQSPGTLSVSPGERVTLSCRASQSVTRNLAWYQQRPGQAPRLLIYSASTRAIGIPVRFSGRGSGTDFTLSISSLQSEDSAVYCQQYNDWLGGTFGQGTKVEIK (SEQ ID NO: 99) | FGQGTKVEIK (SEQ ID NO: 100) |

| Row | Name | V-REGION (1) | FR1 IMGT | CDR1 IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 14 | 005-1F03H | QVQLQESGPG LVKPSQTLSLT CTISGDSVSSA TYYWTWIRQRP GKGLEWIGNIF NSGSTNYNPSL KSRVAISVDTS RNQFSLTLNSL TAADTAVYFCA R (SEQ ID NO: 121) | QVQLQ ESGPG LVKPSQ TLSLTC TIS (SEQ ID NO: 122) | GDSVS SATYY (SEQ ID NO: 123) | WTWIR QRPGK GLEWIG (SEQ ID NO: 124) | IFNSGST (SEQ ID NO: 125) | NYNPSL KSRVAI SVDTS RNQFS LTLNSL TAADTA VYFC (SEQ ID NO: 126) | ARGLE GITVGV YYCDF (SEQ ID NO: 127) | caggtgcagctgcaggtcgggcctggactggtgaagccttcacagaccctgtcactc tgcacctatctctggtgactctgtcagtagcacctatactactggacttggatccgccag cccccagggaagggactggagtggattgggaacatctttaacagtgggagcaccata ctacaacccgtccctcaagagtcgagtcgccatatcagtagacacgtccaggaac cagttctccctgacgctgaactctgtgaccgccgcggacacggccgtctatactgtgcg agggggactcataacaggtgggtcacagggtactactgggacttctgggggccagg gaccccggtcaccgtctcctcagcctccaccaag (SEQ ID NO: 128) | QVQLQESGPGLV KPSQTLSLTCTIS GDSVSSATYYWT WIRQRPGKGLE WIGNIFNSGSTN YNPSLKSRVAISV DTSRNQFSLTLM SLTAADTAVYFC ARGLEGITVGVY YCDFWGQGTLV TVSS (SEQ ID NO: 129) | WGQG TLVTV SS (SEQ ID NO: 130) |
| 15 | 005-1F02L | AIQMTQSPSSV SASVGDRVTIT CRASQENYAL AWYLQKPGKP PKVLIYNASTLK NGVPSRFGGSG SGPDFTLTIS NLQPEDFGTYY CQQFNSY (SEQ ID NO: 131) | AIQMTQ SPSSVS ASVGD RVTITC RAS (SEQ ID NO: 132) | QENYA LA (SEQ ID NO: 133) | LAWYL QKPGK PPKVLI Y (SEQ ID NO: 134) | NAS (SEQ ID NO: 135) | TLKNGV PSRFG GDSGS GPDFTL TISNLQP EDFGT YYC (SEQ ID NO: 136) | QQFNS YPLT (SEQ ID NO: 137) | gccatccagatgacccagtctccatcctccgt gtctgcatctgtaggagacagagtcaccatca cttgccgggcaagtcagagaattatgcttta gcttggtatctgcaaaaaccagggaaaac ccctaagtcctgatctatgatgcatccactttg caaagtggggtcccatcaaggttcagcggc agtggatctgggacagatttcactctcaccatc agcagcctgcagcctgaagattttgcaactta ctactgtcaacagttaacagtaccctcactt (SEQ ID NO: 138) | AIQMTQSPSSVS ASVGDRVTITCR ASQENYALAWY LQKPGKPPKVLIY NASTLKNGVPSR FGGDGSGPDFTL TISNLQPEDFGTY YCQQFNSYPLTF GGGTKVDIR (SEQ ID NO: 139) | FGGGT KVDIR (SEQ ID NO: 140) |

| Row | A Name | C V.REGION (1) | H FR1-IMGT | L CDR1-IMGT | J FR2-IMGT | K CDR2-IMGT | L FR3-IMGT | M CDR3-IMGT | N Sequences | O Translated Sequences V-REGION | P FR4-IMGT |
|---|---|---|---|---|---|---|---|---|---|---|---|
| 18 | 008 2201H | QVQLQESGPG LVKPSETLSLTC SVSGGSISSYY WTWIRQPPGK GLEWIGMYYS GSTYYSPSLKS RVTISIDTSKMQ FSLKLNSVTTA DTAVYYCA (SEQ ID NO: 161) | QVQLQ ESGPG LVKPSE TLSLTC SVS (SEQ ID NO: 162) | GGSISS YY (SEQ ID NO: 163) | WTWIR QPPGK GLEWIG N (SEQ ID NO: 164) | IYYSGST (SEQ ID NO: 165) | YYSPSL KSRVTI SIDTSK MQFSLK LNSVTT ADTAVY YC (SEQ ID NO: 166) | ARDCS GFEDM DSFYYF MDV (SEQ ID NO: 167) | caggtgcagctgcaggagtcgggaccaggactggtgaagccttcggagaccctgtcactcac ctgcagtgtctgtggtggctccatcagtagtac tattggacctggatccggcagccccccaggga agggactggagtggattgggatgtactacagt ggtagcacatactacagcccctccctcaa gagtcgagtcaccatatctatagacacgtc caagaaccaattcctgaaactgaactctgtgact gaccactgcggacggctactgataacgtg cgtctactactgtgcaagagatgaatgga cctccttcctactctcatggacgtctggggccaa gggaccacggtcaccgtctcccctgcat cccgca (SEQ ID NO: 168) | QVQLQESGPGLV KPSETLSLTCSV SGGSISSYYWTW IRQPPGKGLEWI GMYYSGSTYYS PSLKSRVTISIDT SKMQFSLKLNSV TTADTAVYYCAR DCSGFEDMDSF YYFMDVWGKGA TVTVSS (SEQ ID NO: 169) | FGGGT KVEIK (SEQ ID NO: 170) |
| 19 | 008 2201L | EIVLTQSPATLS LSPGERATLSC RASQRLTSSLS WYQQKPGQAP RLLIYAASMRAT GVPARFSGSG SGTDFTLTISSL EPEDFAVYYCQ YRSHWP (SEQ ID NO: 171) | EIVLTQ SPATLS LSPGE RATLSC RAS (SEQ ID NO: 172) | QRLTSS LS (SEQ ID NO: 173) | LSWYQ QKPGQ APRLLI Y (SEQ ID NO: 174) | AAS (SEQ ID NO: 175) | MRATG VPARFS GSGSG TDFTLTI SSLEPE DFAVYY C (SEQ ID NO: 176) | QYRSH WPPA T (SEQ ID NO: 177) | gaaattgttgtgacacagtccccagtccaccct gtctttgtctccaggggaaagagccaccctc tcctgcagggccagtcagcgtcttaccagtact atcctggagctaccaacaaaagcctggccaggct cccaggctcctcatttatgctgcatccactaggc gccactggtgtcccagcaaggttcagtggcagt gggtctgggacagacttcactctcaccatcagc agaactggagcctgaagattttgcggttatt actgtcagtaccagagccgaagccaagtgaa ggttacttcggcgctggaaccaaggctggagat caaacgtaccgtggctgtgcaccatctgcttctt atcttccgccatctgatagatagagtgaaact ggggtgctctgttgtgtgcctgctgaataacct tctctcaagagagcagtccagactctaacaaca ttgagaaacgctccaatggggtaaaccggt ggtgataacctccaatcggggtaactc (SEQ ID NO: 178) | EIVLTQSPATLSL SPGERATLSCRA SQRLTSSLSWYQ QKPGQAPRLLIY AASMRATGVPAR FSGSGSGTDFTL TISSLEPEDFAVY YCQYRSHWPPA VTFGGGTKVEIK (SEQ ID NO: 179) | FGGGT KVEIK (SEQ ID NO: 180) |

| Row | Name | V-REGION (1) | FR1 IMGT | CDR1 IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 26 | 005-3E08H | EVQLVESGGGLVQPGGSLRLSCAASGFSVSSMFMSWVRQTPGKGLEWVSVLYSGATFYADSVKGRFTISRDNSKNTLYLQMDSLRVEDTGVYYCA (SEQ ID NO: 241) | EVQLVESGGGLVQPGGSLRLSCAAS (SEQ ID NO: 242) | GFSVSSMF (SEQ ID NO: 243) | MSWVRQTPGKGLEWVSV (SEQ ID NO: 244) | LVSGGAT (SEQ ID NO: 245) | FYADSVKGRFTISRDNSKNTLYLQMDSLRVEDTGVYYC (SEQ ID NO: 246) | ASRHYNYDDY (SEQ ID NO: 247) | gaggtgcagctgatggagtctgggggaggcttggtccagcctggggggtccctgagactctcctgtgcagcctctggattcagtgtcagtagcatgttcatgagctggttccgccaggctccagggaaggggctggagtgggtctcagttttatatgggatggtagtgcaactatctatgcagactccgtgaagggccgattcaccatctccagagacaattccaagaacacgctgtatctgcaaatggacagcctgagagttgaagacacgggtgtgtattactgtgcg agtcgccactatataatgacgatgactactga (SEQ ID NO: 248) | EVQLVESGGGLVQPGGSLRLSCAASGFSVSSMFMSWVRQTPGKGLEWVSVLYSGATFYADSVKGRFTISRDNSKNTLYLQMDSLRVEDTGVYYCASRHYNYDDYGGQGTLVTVSS (SEQ ID NO: 249) | GGQGTLVTVSS (SEQ ID NO: 250) |
| 27 | 005-3E08L | DVVMTQSPLSLPVTLGQPASISCRSSQSLVHSDGNTYLNWFQQRPGQSLRRLYKVSNRDSGSGSGTDFTLKISRVEAEDVGVYYCMQGTHW (SEQ ID NO: 251) | DVVMTQSPLSLPVTLGQPASISCRSS (SEQ ID NO: 252) | QSLVHSDGNTY (SEQ ID NO: 253) | LNWFQQRPGQSLRRLY (SEQ ID NO: 254) | KVS (SEQ ID NO: 255) | NRDSGVPDRFSGSGSGTDFTLKISRVEAEDVGVYYC (SEQ ID NO: 256) | MQGTHWPT (SEQ ID NO: 257) | gatgttgtgatgactcagtctccactctccctgcccgtcacccttggacagccggcctccatctcctgcaggtctagtcaaagcctcgtacacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaagggacacactgggctccatcggacg (SEQ ID NO: 258) | DVVMTQSPLSLPVTLGQPASISCRSSQSLVHSDGNTYLNWFQQRPGQSLRRLYKVSNRDSGVPDRFSGSGSGTDFTLKISRVEAEDVGVYYCMQGTHWPTFGQGTRLEIK (SEQ ID NO: 259) | FGQGTRLEIK (SEQ ID NO: 260) |

FIG. 12 (continued)

| Row | Name | V-REGION (1) | FR1 IMGT | CDR1-IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 28 | 009-3F05H | EVQLVESGGTV QPGGSLRLSCA VASEYTFRNYW MSWVRQAPGK GLEWVGMNQD GSEKYYVDSVK GRFTISRDNAE NSLRLQMNSLR VADTAVYYCAR (SEQ ID NO: 261) | EVQLVE SGGTV QPGG SLRLSC VAS (SEQ ID NO: 262) | EYTFRN YM (SEQ ID NO: 263) | MSWVR QAPGK GLEWV GM (SEQ ID NO: 264) | INQDGSE K (SEQ ID NO: 265) | YYVDS VKGRF TISRDN AENSLF LQMNS LRVADT AVYYC (SEQ ID NO: 266) | ARAGS YGDYR PMMWF DP (SEQ ID NO: 267) | gaggtgcagctggtggagtctgggggag gcgtccagcctgggaggtccctgagactct cctgtgcagcctctggattcaccttcaggaactatt ggatgagctgggtccgccaggctccagggaa ggggctggagtgggtcggaatgaatcaaaat ggaagtgaaaagtattatgtagactctgtgaag ggccggttcaccatctccagagacaacgcaga gaactcactgcgcctgcaaatgaacagcctgaga gccgaggacacggctgtgtattactgtgcaaga gctggtagtacggaccgtccaatgtggttctggac gggcgttccagggacccgtcaccgtctcctca (SEQ ID NO: 268) | EVQLVESGGTV QPGGSLRLSCVA SEYTFRNYWMS WVRQAPGKGLE WVGMNQDGSE KYYVDSVKGRFT ISRDNAENSLFLQ MNSLRVADTAVY YCARAGSYGDY RPMMWFDPWG RGTLVTVSS (SEQ ID NO: 269) | WGRG TLVTV SS (SEQ ID NO: 270) |
| 29 | 009-3F05L | DIQMTQSPSTL SASVGGRVTIT CRASQSISFSL AWYQQKPGKA PELVIYQTSNLK SGVPSRFSGS GSGTQFTLTISS LQPEDFATYYC QHYSNY (SEQ ID NO: 271) | DIQMTQ SPSTLS ASVGG RVTITC RAS (SEQ ID NO: 272) | QSISFS L (SEQ ID NO: 273) | LAWYQ QKPGK APELVI Y (SEQ ID NO: 274) | QTS (SEQ ID NO: 275) | NLKSG VPSRFS GSGSG TQFTLT ISSLQP EDFATY YC (SEQ ID NO: 276) | QHYSN YSYT (SEQ ID NO: 277) | gacatccagatgacccagtctccttccaccct gtctgcatctgtaggggaccgagtcaccatca cttgccgggccagtcagagtattagtttcagtctgg cctggtaccagcagaaaccagggaaagc ccctgagctcctgatctatcaaacttcaaatttgaagagt ggggtccctcatcagattcagcggcagtgga tctggaacagaattcactctcacaatcagcaccatcc agcctgaagattttgcaacttactactgtcaacaat tactgtagtaactactctactttcggcggagggacc aaggtggaaatcaaacgt (SEQ ID NO: 278) | DIQMTQSPSTLS ASVGGRVTITCR ASQSISFSLAWY QQKPGKAPELVI YQTSNLKSGVPS RFSGSGSGTQFT LTISSLQPEDFAT YYCQHYSNYSYT FGQGTKVEIK (SEQ ID NO: 279) | FGQGT KVEIK (SEQ ID NO: 280) |

| Row | A Name | G V-REGION (†) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 36 | 015-1403H | EVQLVESGRGL VHPGGSLRLSC AASGFTFSSYS MSWVRQAPGK GLEWLATINKE GSENHHVDYA KGRFTISRDNA KNTLYLQMNSL RAEDTAVYYCA R (SEQ ID NO: 341) | EVQLVE SGRGL VHPGG SLRLSC AAS (SEQ ID NO: 342) | GFTFSS YS (SEQ ID NO: 343) | MSWVR QAPGK GLEWL AT (SEQ ID NO: 344) | INKEGSE N (SEQ ID NO: 345) | HHVDY AKGRF TISRDN AKNTLY LQMNS LRAEDT AVYYC (SEQ ID NO: 346) | ARVSR EEWAT VDDPH DYYYM DV (SEQ ID NO: 347) | gaggtgcagctggtgtgagtctggagaggct tgtccaactggggggtccctgagactctcc tgtgcagcctctggattcaccttcagtagctacag catgagctgggtccgccaggctccagggaagg ggctggagtggctggcaaccataaataaggaata gtgaaaatcactatgtggactatgcgaagggccga ttcaccatctccagagacaacgccaagaacacg ctgtatctgcaaatgaacagtctgagagccgaga gaagcgcgacgtgtatacagtaaggacgacgca cagtgtatcgacgactacgattatatacagctg gacgtctgggggccaagggaccacggtcacc gtctcctcaactccaacccctctccaagaccactc cttcacctgcgaggcagctgccctggcctgctgct caaggaactactccctccgacagtgtgaccggtg tccctgaagtaagctcaacgtgggactgtgacggg tcgtaccaactcccgggctgctctaca (SEQ ID NO: 348) | EVQLVESGRGLV HPGGSLRLSCAA SGFTFSSYSMS WVRQAPGKGLE WLATINKEGSEN HHVDYAKGRFTI SRDNAKNTLYLQ MNSLRAEDTAVY YCARVSREEWA TVDDPHDYYYM DVWGQGTTVTV SS (SEQ ID NO: 349) | WGQG TTVTV SS (SEQ ID NO: 350) |
| 37 | 015-1403L | DIQMTQSPSSL SASVGDRVTIT CRASQRISNYL NWYQQMPGRA PKLLIYKAYNLE RGVPSRFSGS GSGTDFTLTIST LQPEDFGTYYC QQMYNP (SEQ ID NO: 351) | DIQMTQ SPSSLS ASVGD RVTITC RAS (SEQ ID NO: 352) | QRISNY L (SEQ ID NO: 353) | LNWYQ QMPGR APKLLI Y (SEQ ID NO: 354) | KAY (SEQ ID NO: 355) | NLERG VPSRFS GSGSG TDFTLTI STLQPE DFGTY YC (SEQ ID NO: 356) | QQMYN PLFT (SEQ ID NO: 357) | gacatccagatgacccagtctccatcctccct gtctgcatctgtaggagacagagtcaccatcaca tgtcgggcaagtcagagaattagcaactatttag cttaatggtatcaacagatgccagggcagagca ggcccttaaactcctgatctataaagcatacaa tttagaaagtggggtcccatcgaggttcagtggc agtggatctggggacggattcactctcaccatcag catactgccagcctgaagattttgggacttactactg ttacagcaaatgtataaatcccctgttca cctcctggcggtgctgccaacctccgaactctcttc ccagaaggccaaaatctcagtgaactccagg gaaaagccgccacaatgggtgatcaactccagg agg (SEQ ID NO: 358) | DIQMTQSPSSLS ASVGDRVTITCR ASQRISNYLNWY QQMPGRAPKLLI YKAYNLERGVPS RFSGSGSGTDFT LTISTLQPEDFGT YYCQQMYNPLFT FGGGTKVEIK (SEQ ID NO: 359) | FGGGT KVEIK (SEQ ID NO: 360) |

| Row | Name | V REGION (1) | FR1 IMGT | CDR1 IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 42 | B15-2408H | QVQLVQSGAEVKRPGTSVKVSCKASGYIFSGSYIQWVRQAPGQGLEWMGRINPKTGNTNYAQKFQGRVTMTRDMSISTAYMELTRLSSDDTAVYYCAR (SEQ ID NO: 401) | QVQLVQSGAEVKKPGTSVKVSCKAS (SEQ ID NO: 402) | GYIFSGSY (SEQ ID NO: 403) | IQWVRQAPGQGLEWMGR (SEQ ID NO: 404) | INPKTGMT (SEQ ID NO: 405) | NYAQKFQGRVTMTRDMSISTAYMELTRLSSDDTAVYYC (SEQ ID NO: 406) | ARDFYGDYRGSAFDI (SEQ ID NO: 407) | caggtgcagctggtgcagtctggggctgaggtgaagaagcctggggcctcagtgaaggtctcctgcaaggcttctggatacatcttcagtggctatt gtatacagtgggtccgacaggcccctggacaagggcttgagtggatgggacggatcaaccctaagactggtaataccaactatgcacagaagtt tcagggcagggtcaccatgaccagggacatgtccatcagcacagcctacatggagctgaccaggctgagatctgacgacacggccgtgtattact gtgcgagagactttgatatgggtgactaccggggctccagcattcccctatctctcccagagacaccctctccagacaccctctccagacaccctctccc gaagacacggccgtggtctactggggccagggcaccctggtcaccgtctccagcg (SEQ ID NO: 408) | QVQLVQSGAEVKRPGTSVKVSCKASGYIFSGSYIQWVRQAPGQGLEWMGRINPKTGNTNYAQKFQGRVTMTRDMSISTAYMELTRLSSDDTAVYYCARDFYGDYRGSAFDIWGQGAMVTVSS (SEQ ID NO: 409) | WGQGAMVTVSS (SEQ ID NO: 410) |
| 43 | B15-2408L | DIQMTQSPSSLSASVGDRVTITCQQPSQDFSNYLNWYQQKPGKAPKLLIYDTSNLETGVPSRFSGSGSGTHFTLTINSLQPEDIATYYCQQ (SEQ ID NO: 411) | DIQMTQSPSSLSASVGDRVTITCQPS (SEQ ID NO: 412) | QDFSNY (SEQ ID NO: 413) | LNWYQQKPGKAPKLLIY (SEQ ID NO: 414) | DTS (SEQ ID NO: 415) | NLETGVPSRFSGSGSGTHFTLTINSLQPEDIATYYC (SEQ ID NO: 416) | QQLNT (SEQ ID NO: 417) | gacatccagatgacccagtctccatcctccctgtctgcatctgtaggagacagagtcaccatcacttgccgggcaagtcagagcattagcaactatt taaattggtatcagcagaaaccagggaaagcccctaagctcctgatctatgatacatccaatttggaaacaggggtcccatcaaggttcagcggca gtggatctgggacagattttactttcaccatcagcagcctgcagcctgaagatattgcaacatactactgtcaacagttaaataccttctctcccagga aacggaaagctggaagttcggcagggggaccaagctggagatcaaac (SEQ ID NO: 418) | DIQMTQSPSSLSASVGDRVTITCQPSQDFSNYLNWYQQKPGKAPKLLIYDTSMLETGVPSRFSGSGSGTHFTLTINSLQPEDIATYYCQQLNTFGPGT (SEQ ID NO: 419) | FGPGTKVDK (SEQ ID NO: 420) |

| Row | Name | V REGION (1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
|---|---|---|---|---|---|---|---|---|---|---|---|
| 46 | 015-2C03H | EVQLVESGGGLVQPGGSLRLSCAASGFTFSSYSMSWVRQAPGKGLEWVANIKEGSEKNHVDFVKGRFTISRDNAKNTLSLQMNSLRAEDSAVYYCAR (SEQ ID NO: 441) | EVQLVESGGGLVQPGGSLRLSCAAS (SEQ ID NO: 442) | GFTFSSYS (SEQ ID NO: 443) | MSWVRQAPGKGLEWVAN (SEQ ID NO: 444) | IKEGSEK (SEQ ID NO: 445) | NHVDFVKGRFTISRDNAKNTLSLQMNSLRAEDSAVYYC (SEQ ID NO: 446) | ARVSREEWAIVDDPHDYYYMDV (SEQ ID NO: 447) | gaggtgcagctggtggagtctgggggaggcttggtccagcctggggggtccctgagactctcctgtgcagcctctggattcaccttcagtagctatagcatgtcttgggtccgccaggctccagggaaggggctggagtgggtggccaatataaaagaaggtagtgagaagaatcatgtagacttgtgaaggccgcttcactatctccagagacaacgccaagaactcactgtctgcaaatgaacagcctgagagccgaggacacggccgtgtattactgtgcgagagtctcccgtgaatgagtgggctatagatgaccctcacgactactactacatggacgtctggggccaagggaccacggtcaccgtctcctcaagg (SEQ ID NO: 448) | EVQLVESGGGLVQPGGSLRLSCAASGFTFSSYSMSWVRQAPGKGLEWVANIKEGSEKNHVDFVKGRFTISRDNAKNTLSLQMNSLRAEDSAVYYCARVSREEWAIVDDPHDYYYMDVWGQGTTVTVSS (SEQ ID NO: 449) | WGQGTTVTVSS (SEQ ID NO: 450) |
| 47 | 015-2C03L | DIQMTQSPSSLSASVGDRVTITCRASQRISNYLNWYQQRPGEAPKLLIYNAYTLESGVPSRFSGSGSGTDFTLTISSLQPEDFATYYCQQSYIT (SEQ ID NO: 451) | DIQMTQSPSSLSASVGDRVTITC (SEQ ID NO: 452) | QRISNY (SEQ ID NO: 453) | LNWYQQRPGEAPKLLIY (SEQ ID NO: 454) | NAY (SEQ ID NO: 455) | TLESGVPSRFSGSGSGTDFTLTISSLQPEDFATYYC (SEQ ID NO: 456) | QQSYIT LFT (SEQ ID NO: 457) | gacatccagatgacccagtctccatcctccctgtctgcatctgtaggagacagagtcaccatcacttgccgggcaagtcagagaattagcaactatttaaattggtatcagcagagaccagggaaagcccctaagctcctgatctataatgcatacactttagaaagtggggtcccatcaagtttcagtggcagtggatctgggacagatttcactctcaccatcagcagtctgcaaccgaagattttgctacttactactgtcaacagagttacagtacccctcttcactttcggcggagggaccaaggtggagatcaaa (SEQ ID NO: 458) | DIQMTQSPSSLSASVGDRVTITCRASQRISNYLNWYQQRPGEAPKLLIYNAYTLESGVPSRFSGSGSGTDFTLTISSLQPEDFATYYCQQSYITLFTFGGGTKVEIK (SEQ ID NO: 459) | FGGGTKVEIK (SEQ ID NO: 460) |

FIG. 12 (continued)

| Row | A Name | G V-REGION (1) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 48 | 015-2C04H | EVQLLESGGAL LQPGGSLRLSC AASGFTFSSYA MSWVRQPPGK GLQWVSIMSG RGDTMQYADS VKGRFTISRDN SKMTLYLQMNS LRAEDTAIYYCA R (SEQ ID NO: 461) | EVQLLE SGGALL QPGGS LRLSCA AS (SEQ ID NO: 462) | GFTFSS YA (SEQ ID NO: 463) | MSWVR QPPGK GLQWV SI (SEQ ID NO: 464) | MSGRGD TM (SEQ ID NO: 465) | QVADS VKGRF TISRDN SKMTLY LQMNS LRAEDT AIYYC (SEQ ID NO: 466) | AREEFT DTEMTI TQGDF GY (SEQ ID NO: 467) | gaggtgcagctgttggagtctgggggaggctt gctacagcctggggggtccctgagactctctcct gtgcagcctctggattcaccttcagcagctatg ccatgagctgggtccgccaggctccagggaa gggtctgcagtgggtctcaattatgagtggtag gggtgacacgatgcaatacgcagactccgtg aagggccggttcaccatctccagagacaat ccaagaacacgttactgcaaatgaacag cctgagagccgaggacacggccatttattact gtgcgagagaagaatttactgacgaaatgacg atacactcaaggcgacttggactggggccaa gggaccctggtcactgtgctagttcagggaagcta cttccc (SEQ ID NO: 468) | EVQLLESGGALL QPGGSLRLSCAA SGFTFSSYAMS WVRQPPGKGLQ WVSIMSGRGDT MQYADSVKGRF TISRDNSKNTLYL QMNSLRAEDTAI YYCAREEFTDTE MTITQGDFGYW GQGTLVTVSS (SEQ ID NO: 469) | WGQG TLVTV SS (SEQ ID NO: 470) |
| 49 | 015-2C04L | DIQMTQSPSSL SASVGDRVTIT CRASQSISVYL NWYQQKPGKA PKLLIYGASNLQ SGVPSRFSGS GSETDFTLTISS LQPEDFATYYC QRSYIT (SEQ ID NO: 471) | DIQMTQ SPSSLS ASVGD RVTITC RAS (SEQ ID NO: 472) | QSISVY LA (SEQ ID NO: 473) | LNWYQ QKPGK APKLLI Y (SEQ ID NO: 474) | GAS (SEQ ID NO: 475) | NLQSG VPSRFS GSGSE TDFTLTI SSLQPE DFATYY C (SEQ ID NO: 476) | QRSYIT PFT (SEQ ID NO: 477) | gacatccagatgacccagtctccatcctcc gtctcatctgtaggagacagagtcaccatcacttgc cgggcgagtcagagtatagtagttacttgaatt ggtatcagcaaaaaccagggaaagc ccctaagctcctgatctatggtgcatccaatttg caaagtggtgtcccatcaagttcagtggcag tggatctgggacagattcactctcaccatca gcagtctgcaaatctgaagatttgcaacttact actgtcaacgtcggaagttacatcactcctttcccgc acgttggccagggaccaagctggagatcaaacgt (SEQ ID NO: 478) | DIQMTQSPSSLS ASVGDRVTITCR ASQSISVYLNWY QQKPGKAPKLLI YGASNLQSGVPS RFSGSGSETDFT LTISSLQPEDFAT YYCQRSYITPFTF GPGTKVDK (SEQ ID NO: 479) | FGPGT KVDK (SEQ ID NO: 480) |

| Row | A Name | G V-REGION (1) | H FR1-IMGT | I CDR1-IMGT | J FR2-IMGT | K CDR2-IMGT | L FR3-IMGT | M CDR3-IMGT | N Sequence | O Translated Sequence (V REGION) | P FR4-IMGT |
|---|---|---|---|---|---|---|---|---|---|---|---|
| 52 | 015-2002H | QVQLVQSGAE VKKPGASVKVS CKASGFRFSDL YIHWVRQAPG QGLEWMGRIN PTRGTTKYAEK FLGRVSMTRDT AISTAYLDVTR LQSDDTALYYC ARDIDSGDYRA A DVFQWGQGT M VTVSS (SEQ ID NO: 501) | QVQLV QSGAE VKKPG ASVKVS CKAS (SEQ ID NO: 502) | GFRFS DLY (SEQ ID NO: 503) | IHWVR QAPGQ GLEWM GR (SEQ ID NO: 504) | INPTRGT T (SEQ ID NO: 505) | KVAEKF LGRVS MTRDT AISTAY LDVTRL QSDDT ALYYC (SEQ ID NO: 506) | ARDIDS GDYRA ADVFQI (SEQ ID NO: 507) | caggtgcagctggtgcagtctggggctgaggt gaagaagcctggggcctcagtgaaggtctcc tgcaaggcttctggattcaggtttagtgacctgt atatacactgggtgcgacaggcccctggaca agggcttgagtggatggggaatatcaaccc a ccgaggaaccacaaaatatgcagagaaatt tcttggccgagtcatgaccaggactgtacgg acc aggctgcaatctgaatgacagctccgtctattc actgcgcggacagactgactgacgtggtggc catcaatggctcaccgctctccgctgaaggacc aagggcagctgcagacatcagagagg acc tcggctctgctgtgcaaggactatttccgg acc (SEQ ID NO: 508) | QVQLVQSGAEVK KPGASVKVSCKA SGFRFSDLYIHW VRQAPGQGLEW MGRINPTRGTTK YAEKFLGRVSMT RDTAISTAYLDVT RLQSDDTALYYC ARDIDSGDYRAA DVFQWGQGTM VTVSS (SEQ ID NO: 509) | WGQG TMVTV SS |
| 53 | 015-2002L | DIQMTQSPSSL SASVGDRVTIT CQASQDFSNY LA NWYQQKPGKA PKLLIYDASMLE TGVPSRFSGSG SGTEYTLTISSL QPEDFATYYCQ Q (SEQ ID NO: 511) | DIQMTQ SPSSLS ASVGD RVTITC QAS (SEQ ID NO: 512) | QDFSN Y (SEQ ID NO: 513) | LNWYQ QKPGK APKLLI Y (SEQ ID NO: 514) | DAS (SEQ ID NO: 515) | MLETGV PSRFS GSGSG TEYTLTI SSLQPE DFATYY C (SEQ ID NO: 516) | QQLAT (SEQ ID NO: 517) | gacatccagatgacccagtctccatcctcct gtctgcgtctgtaggagacagagtcaccatca catgccaggcagcagtttagcaactatt taatttggtatcagcagaaaccagggaaag cccctaagctcctgatctacgatgcatccatt tgaaaccgaggtctccatcaaggttcagtgga agtggatctgggacagaattcactttcaccatc agtagcctgcagcctgaagactttgcaacatta ctactgtcaacagtatgattataaccgtacggg ttcgggggaaccaaggggactgctgaccgtcctaggatgctgt tccatctgtcttcatcttcccgccatctgatgga gcaagtgcaactgcttctgaactggaggccca agtagcagtggaaggtggataacgcctccaa tcgggtaactcccaggagagtgtcacagagc (SEQ ID NO: 518) | DIQMTQSPSSLS ASVGDRVTITCQ ASQDFSNYLNW YQQKPGKAPKLL IYDASMLETGVPS RFSGSGSGTEYT LTISSLQPEDFAT YYCQQLAT (SEQ ID NO: 519) | FGPGT KVDIK (SEQ ID NO: 520) |

| Row | Name | V-REGION (1) | FR1 IMGT | CDR1 IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 56 | 015-2E6H | EVQLVESGGGL VQPGGSLRLSC AASGFTFSSYS MSWVRQAPGK GLEWVANMKE GGEKNHVDY VKGRFTISRDN AKSTLYLQMNS LRAEDTAVYYC AR (SEQ ID NO: 541) | EVQLVE SGGGL VQPGG SLRLSC AAS (SEQ ID NO: 542) | GFTFSS YS (SEQ ID NO: 543) | MSWVR QAPGK GLEWV AN (SEQ ID NO: 544) | MMKEGG EK (SEQ ID NO: 545) | NHVDY VKGRF TISRDN AKSTLY LQMNS LRAEDT AVYYC (SEQ ID NO: 546) | ARVSR EEWAT VDDPH DYYYM DV (SEQ ID NO: 547) | gaggtgcagctggtggagtctgggggaggct tgtgcagcctggggggtccctgagactctcct gcgcagcctctggattcaccttcagtagctatc gcatgagctgggtccgccaggctccagggaa ggggctggagtgggtcgcaaatgaaaa aggggaaggtgtgaaaaaaccatgttggacta tgtgaagggccgattcaccatctccagagaca acgccaagaactcactgtatctgcaaatgaat agtctgagagccgaagtcgaggacactgccgt ttactactgtgcgagagtcagagaatgggct tggccgtgtgggccaagtgaccatacctgct cctctccaccctggacctgctcggggccctact cgtctaaga (SEQ ID NO: 548) | EVQLVESGGGLV QPGGSLRLSCAA SGFTFSSYSMS WVRQAPGKGLE WVANMKEGGE KNHVDYVKGRFT ISRDNAKSTLYLQ MNSLRAEDTAVY YCARVSREEWA TVDDPHDYYYM DVWGQGTTVTV SS (SEQ ID NO: 549) | WGQG TTVTV SS (SEQ ID NO: 550) |
| 57 | 015-2E6L | DIQMTQSPSSL SASVGDRVTIT CRASQRISNYL NWYHQQPGKA PKLLIYNAYTLQ SGVPSRFSGTG SGTDFTLTISSL QPEDFGTFYCQ QSYNSLFT (SEQ ID NO: 551) | DIQMTQ SPSSLS ASVGG RVTITC RAS (SEQ ID NO: 552) | QRISNY L (SEQ ID NO: 553) | LNWYH QQPGK APKLLI Y (SEQ ID NO: 554) | NAY (SEQ ID NO: 555) | TLQSG VPSRFS GTGSG TDFFTLTI NO: SSLQPE DFGTFY C (SEQ ID NO: 556) | QQSYN SLFT (SEQ ID NO: 557) | gacatccagatgacccagtctccatctcct gtctgcatctgtagagaatcagagtccactca ctgctcgggcaagtcagaggattagcaactta ctaaattggtatcaccaacaaccaggaa gccctaaactctgatctatattagctataaact ttacagattggcatcccatcaaggttcgtgg cagtggatctggacagatttactctcaccat cagcagtctgcaacctgaagattttgcgacttac tactgtcaacagagttacaatagccgtcttccact tcggcggggggaccaagttggagatcaaaac (SEQ ID NO: 558) | DIQMTQSPSSLS ASVGGGVTITCR ASQRISNYLNWY HQQPGKAPKLLI YNAYTLQGVPS RFSGTGSGTDFT LTISSLQPEDFGT FYCQQSYNSLFT FGGGTKVEIK (SEQ ID NO: 559) | FGGGT KVEIK (SEQ ID NO: 560) |

| Row | A Name | G V-REGION (l) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 61 | 015-2F02 | DIQMTQSPSSL SASVGDRVTIT CQASQDFSNFL NWYQQRPGKA PKLLIYDASMLE TGVPSRFSGRK SGAHYTLTISSL QAEDIATYYCQ Q (SEQ ID NO: 591) | DIQMTQ SPSSLS ASVGD RVTITC QAS (SEQ ID NO: 592) | QDFSN F (SEQ ID NO: 593) | LNWYQ QRPGK APKLLI Y (SEQ ID NO: 594) | DAS (SEQ ID NO: 595) | MLETGV PSRFS GRKSG AHYTLT ISSLQA EDIATY YC (SEQ ID NO: 596) | QQLDT (SEQ ID NO: 597) | gacatccagatgacccagtctccatctcct gtctgcatctgtaggagacagagtcaccatca cttgccaggcgagtcaggacttagtaatttctt aaattggtatcaacagagacccgggaaagcc cctaaactcctgatctacgatgcatccaattag gcaagtgggtccccatcaaggttcagtggaag ggatctgggacagattcactttcaccatcaca gcagctgcaggctgaagatattgcaacatat tattgtcaacagttgtataactaccgctggcgc ccaaagttggataccttcatcccgccatcgatgag acatcgtttttcatcttccccccaatctgatgagc cagttgaaatctggaactgcctctgttgtgtgc ttcctgaataacttctatcccagagaggccaaa gtacagtggaaggtggataacgcctccaat cgggtaactcccaggagagtgtcacagagc aggacagcaaggacagcacctacagcctc agcagcaccctgacgctgagcaaagcagac tacgagaaacacaaagtctacg (SEQ ID NO: 598) | DIQMTQSPSSLS ASVGDRVTITCQ ASQDFSNFLNWY QQRPGKAPKLLI YDASMLETGVPS RFSGRKSGAHYT LTISSLQAEDIAT YYCQQLDTFGPG TKVDIK (SEQ ID NO: 599) | FGPGT KVDIK (SEQ ID NO: 600) |

FIG. 12 (continued)

| A | G | H | I | J | K | L | M | N | O | P |
|---|---|---|---|---|---|---|---|---|---|---|
| Row Name | V-REGION (1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
| 52 | 015-2F04H | QVQLVQSGAE VKKPGTSVKVS CKASGYIFSGS YIQWVRQAPG QGLEWMGRIM NPKTGGTNYPQK FQGRVTMTRD MSISTAYMELS RLISDDTAVYY CAR (SEQ ID NO: 601) | QVQLV QSGAE VKKPG TSVKVS CKAS (SEQ ID NO: 602) | GYIFSG SY (SEQ ID NO: 603) | IQWVR QAPGQ GLEWM GR (SEQ ID NO: 604) | INPKTGG T (SEQ ID NO: 605) | NYPQK FQGRV TMTRD MSISTA YMELS RLISDD TAVYYC (SEQ ID NO: 606) | ARDFD YGDYR GSAFDI (SEQ ID NO: 607) | caggtgcagctggtgcagtctggggctgaggt gaagaagcctggggcctcagtgaaggtctcct gcaaggcttctggatacatcttctccggttcct atatccattgggtgcgacaggcccctggaca agggcttgagtggatggggaaggatcaaccct aagactggtggcacaaattatccacagaagtt tcagggcaggggtcaccatgaccagggacat gtccatcagcactgctacatggaggtgagctgagta ggctgatctgatgactgacgtgctgcctattact gtgcagagactcgattcgacgacggctgtattact gctctgcttgatctgggagacactgggaacagggca atgtccatcgtccaggtggagaacaacacgt gctgcctcagtcaggtgacacttcccgaactgt gaggtcttgtgacaccttccaggcgcctgacc agcggcgtgcacactcaggcgctgcgatcacca gtcatcagagctctactcc (SEQ ID NO: 608) | QVQLVQSGAEVK KPGTSVKVSCKA SGYIFSGSYIQW VRQAPGQGLEW MGRIMPKTGGTN YPQKFQGRVTM TRDMSISTAYME LSRLISDDTAVYY CARDFDYGDYR GSAFDIWGQGA MVTVSS (SEQ ID NO: 609) | WGQG AMVTV SS (SEQ ID NO: 610) |

FIG. 12 (continued)

| Row | A Name | G V-REGION (1) | H FR1 IMGT | I CDR1 IMGT | J FR2 IMGT | K CDR2 IMGT | L FR3 IMGT | M CDR3 IMGT | N Sequence | O Translated Sequence (V-REGION) | P FR4 IMGT |
|---|---|---|---|---|---|---|---|---|---|---|---|
| 63 | 015. 2F04 | DIQMTQSPSSL SASVGDRVTIT CQTSQDFSNYL NWYQQKPGKA PKLLIHDTSKLE TGVPSRFSGG GAGTYFTLTIN GLQPEDIATYW CQQ (SEQ ID NO: 611) | DIQMTQ SPSSLS ASVGD RVTITC QTS (SEQ ID NO: 612) | QDFSN Y (SEQ ID NO: 613) | LNWYQ QKPGK APKLLI H (SEQ ID NO: 614) | DTS (SEQ ID NO: 615) | KLETGV PSRFS GGGAG TYFTLTI NGLQP EDIATY WC (SEQ ID NO: 616) | QQLNT (SEQ ID NO: 617) | gacatccagatgacccagtctccatcctcct gtctgcatctgtaggagacagagtcaccatcacc tgccaggactcagtcaggactttagcaattattta aattggtatcagcagaaaccagggaaagcc cctaaactcctgatccatgatacatccaagttg gaaacaggggtcccatcaagattcagtggc agtggatctgggacagattttactctcaccatca acggctccagcctgaatccgaagactgcaa ttgctacaagttgaatcaacgtaacgtatgtggc accatcgtctcatcttcctgccatctgatga gcagttgaaatctggaactgcctctgttgtgtg cctgctgaataactactatcccagagaggcca aatggggtaactcccaagagagtgtccacag cttgggaaggcagaggcaagtgcacctacagctc actacgagaaacacaaagtctac (SEQ ID NO: 618) | DIQMTQSPSSLS ASVGDRVTITCQ TSQDFSNYLNWY QQKPGKAPKLLI HDTSKLETGVPS RFSGGGAGTYFT LTINGLQPEDIAT YWCQQLNTFGP GTKVDIK (SEQ ID NO: 619) | FGPGT KVDIK (SEQ ID NO: 620) |

FIG. 12 (continued)

| Row | Name | V-REGION (1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
|---|---|---|---|---|---|---|---|---|---|---|---|
| 64 | 015-2F08H | EVQLLESGGGLV QPGGSLRLSCA ASGFIFRSYA MSWVRQAPGK GLEWVSMSGS SEDTHYADSVK GRFTISRDNSK NTVYLRMNNLR AEDTAFYYCAR (SEQ ID NO: 621) | EVQLLE SGGGL VQPGG SLRLSC AAS (SEQ ID NO: 622) | GFIFRS YA (SEQ ID NO: 623) | MSWVR QAPGK GLEWV SM (SEQ ID NO: 624) | ISGSSED T (SEQ ID NO: 625) | HYADS VKGRF TISRDN SKNTVY LRMNN LRAEDT AFYYC (SEQ ID NO: 626) | AREEFT DTEMT INQGDF AY (SEQ ID NO: 627) | gaggtgcagctgttggagtctgggggaggcttggtacagcctggggggtccctgagactctcctgtgcagcctctggattcatcttcgagtagctatgccatgagctggttgccgccaggcaagggctccaggatggtctgaatgagtgagctagtgagtgaggatgtctgaagaagcggatcaacagcaagaacacggtgtacctgcggatgaacaacctgagagccgaggacacggctacttactgt gcgagagagaggagttaccgacacagagatgatcaaccaaggggacttgcctactgggggccaagggaccacggtcaccgtctcctcagcgt (SEQ ID NO: 628) | EVQLLESGGGLV QPGGSLRLSCAA SGFIFRSYAMSW VRQAPGKGLEW VSMSGSSEDTH YADSVKGRFTIS RDNSKNTVYLRM NNLRAEDTAFYY CAREEFTDTEMT INQGDFAYWGH GTLVTVSS (SEQ ID NO: 629) | WGHG TLVTV SS (SEQ ID NO: 630) |

FIG. 12 (continued)

| Row | Name | V-REGION (1) | FR1 IMGT | CDR1 IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 65 | 015 2F06L | DIQMTQSPSSL SASVGDTVTIT CRASQSISVYL NWYQQKPGKA PKLLIYGASILQ SGVPSRFSGIG SGTDFTLTISSL QPEDFATYYCQ RSFIT (SEQ ID NO: 631) | DIQMTQ SPSSLS ASVGD TVTITC RAS (SEQ ID NO: 632) | QSISVY (SEQ ID NO: 633) | LNWYQ QKPGK APKLLI Y (SEQ ID NO: 634) | GAS (SEQ ID NO: 635) | ILQSGV PSRFS GIGSGT DFTLTI SSLQPE DFATYY C (SEQ ID NO: 636) | QRSFIT PFT (SEQ ID NO: 637) | gacatccagatgacccagtctccatcctcc ctgtctgcatctgtaggagacacagtcaccatca cttgccgggccagtcagagcattagtgtgtattt aaattggtatcaaaaaaccagggaaagc ccctaagctcctgatctatggtgcatccatttgc aaagtggggtcccgtcaaggttcagtggcattg gatctgggacagatttcactctcaccatcagc agtctgcaactggaggttcatctactactac tgtcaacggagttcattcactcctcacttcg gccctgggaccaaactgagatcaaagtac ggtgctgcaccatctgtcttcatcttccgccagcca tctgatgaagaattgaaatctggaactgcctct gttgttgtctgcctgaataacttctatccccgagag aggccaaagtacagtggaaggtggataacg ccctccaatcggtaactcccaggagagtgtc acagagcaggacagcaaggacagcacctta agcagcactctacgctgagcaaagcagac tacgagaaacacaaagtctacgcctgcgaagtc acccatcagggcctgagctcgcccgtcaca aagagcttcaacaggggagagtgt (SEQ ID NO: 638) | DIQMTQSPSSLS ASVGDTVTITCR ASQSISVYLNWY QQKPGKAPKLLI YGASILQSGVPS RFSGIGSGTDFT LTISSLQPEDFAT YYCQRSFITPFTF GPGTKVDIK (SEQ ID NO: 639) | FGPGT KVDIK (SEQ ID NO: 640) |

| Row | A Name | G V-REGION (1) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 66 | 015-2394H | QVQLVQSGAE VKKPGTSVKVS CKASGYVFSDS YIQWVRQAPG QGLEWMGRIN PKTGGTNFAQK FQGRVTMTRD MSISTAYMDLS RLISDDTAVYY CAR (SEQ ID NO: 641) | QVQLV QSGAE VKKPG TSVKVS CKAS (SEQ ID NO: 642) | GYVFS DSY (SEQ ID NO: 643) | IQWVR QAPGQ GLEWM GR (SEQ ID NO: 644) | INPKTGG T (SEQ ID NO: 645) | MFAQK FQGRV TMTRD MSISTA YMDLS RLISDD TAVYYC (SEQ ID NO: 646) | ARDFD YGDYR GSAFDI (SEQ ID NO: 647) | caggtgcagctggtgcagtctggggctgaggt gaagaagcctggggcctcagtgaaggtctcc tgcaaggcttctggatacgtcttcagcgactcct atatcaatgggtacgacagcccctggaca agggcttgagtggatggggaaggatcaatcct aagactggtggcacaaattgccacagaagtt tcaagcaggtcaccatgaccagggacat gtccatcagtgcaagccttgataatact gcggtcattgacgacgcggatatact gtgcgagagattgatatcagcgtgaccaggga ggctctgtttgatatcttcagcgtcaccctctcaa gagcgccctgggggactacgcggccgaaccgttggg ctgccgttcgtcgaggactactccccgaactgt gacgtctcgtggaactacttaggagtcctgacc aagcggttcatcaaacttccgggctcctacaa gtcctcaggactact (SEQ ID NO: 648) | QVQLVQSGAEVK KPGTSVKVSCKA SGYVFSDSYIQW VRQAPGQGLEW MGRINPKTGGTN FAQKFQGRVTMT RDMSISTAYMDL SRLISDDTAVYYC ARDFDYGDYRG SAFDIWGQGAM VTVSS (SEQ ID NO: 649) | WGQG AMVTV SS (SEQ ID NO: 650) |

| Row | A Name | G V-REGION (1) | H FR1-IMGT | I CDR1 IMGT | J FR2 IMGT | K CDR2 IMGT | L FR3 IMGT | M CDR3 IMGT | N Sequence | O Translated Sequences (V-REGION) | P FR4-IMGT |
|---|---|---|---|---|---|---|---|---|---|---|---|
| 67 | 015. 23D4L | DIQMTQSPSSL SASVGDRVTIT CQTSQDFSMYL NWYQQKPGKA PKLLIHDTSKLE TGVPSRFSGG SAGTYFTLTIN GLQPEDIATYW CQQ (SEQ ID NO: 651) | DIQMTQ SPSSLS ASVGD RVTITC QTS (SEQ ID NO: 652) | QDFSM Y (SEQ ID NO: 653) | LNWYQ QKPGK APKLLI H (SEQ ID NO: 654) | DTS (SEQ ID NO: 655) | KLETGV PSRFS GGGAG TYFTLTI NGLQP EDIATY WC (SEQ ID NO: 656) | QQLNT (SEQ ID NO: 657) | gacatccagatgacccagtctccatcctcc ctgtctgcatctgtgggagacagagtcacc atcacttgccagacgagtcaggacttcagc atgtatttaaattggtatcagcagaaacca gggaaagcccctaagctcctgatccatgac acatccaaattgtaaactggggtcccatca aggttcagtggcagtggatctggaacagat ttcactctcaccatcaacggcctgcagcct gaagatattgcaacatattactgtcaacaa ctgaatactccgctcactttcggccctggg accaaagtggatatcaaacgtacggtggct gcaccatctgtcttcatcttcccgccatctg atgagcagttgaaatctggaactgcctctg ttgtgtgcctgctgaataacttctatcccaga gaggccaaagtacagtggaaggtggataac gccctccaatcgggtaactcccaggagagt gtcacagagcaggacagcaaggacagcacc tacagcctcagcagcaccctgacgctgagc aaagcagactacgagaaacacaaagtctac gcctgcgaagtcacccatcagggcctgagc tcgcccgtcacaaagagcttcaacaggggag agtgt (SEQ ID NO: 658) | DIQMTQSPSSLS ASVGDRVTITCQ TSQDFSMYLNWY QQKPGKAPKLLI HDTSKLETGVPS RFSGGSAGTYFT LTINGLQPEDIAT YWCQQLNTPLTF GQGTKVDIK (SEQ ID NO: 659) | FGPGT KVDIK (SEQ ID NO: 660) |

| Row | Name | V-REGION (1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
|---|---|---|---|---|---|---|---|---|---|---|---|
| 71 | B18-1603L | DIVMTQSPDSL AVSLGERATVN CRASQSVLYNS NNKNYLTWYQ QKPGQSPKLLI YWASTRESGV PDRFSGSGSG TDFTLTISSLQA EDVAVYYCHQ HYTIP (SEQ ID NO: 691) | DIVMTQ SPDSLA VSLGE RATVN CRAS (SEQ ID NO: 692) | QSVLY NSMNK NY (SEQ ID NO: 693) | LTWYQ QKPGQ SPKLLI Y (SEQ ID NO: 694) | WAS (SEQ ID NO: 695) | TRESG VPDRF SGSGS GTDFTL TISSLQ AEDVA VYYC (SEQ ID NO: 696) | HQHYTI PPT (SEQ ID NO: 697) | gacatcgtgatgacccagtctccagactcct ggctgtctctgtgggcgagggccaccgtc aactcaataataagaactactaactgttataca actccaataataagaactactaactgttacc agtcagaaccaggcagctcccggaatccggg cattactggtaccagcagaaacagccgggt tcctgaccgatattacttccagggtcag caccatcctgatctatcccgccagagaggccaa gtagttgaaactcgagaatcaagtacgttggg gcagttgaaatctgaactgcctctgtctgatga gagctgctgcgacactctgtcaccagtaccc agtcagtgaagtggatgaaccccaa tcgaggaaccccaggagagtgcacacagc aggacaaggacagcacctaccacagctc agcagcccctgaccgctgagc (SEQ ID NO: 698) | DIVMTQSPDSLA VSLGERATVNCR ASQSVLYNSNNK MYLTWYQQKPG QSPKLLIYWAST RESGVPDRFSGS GSGTDFTLTISSL QAEDVAVVYCH QHYTPPTFGPG TKVEIK (SEQ ID NO: 699) | FGPGT KVEIK (SEQ ID NO: 700) |

| Row | A Name | G V-REGION (†) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 76 | 013-280H | EVQLLESGGGL VQPGGSLRLSC AASGFTLGDYS MTWVRQAPGK GLEWVSSIRKS GGDTFYTDSVK GRFTISRDTPK NTLFLQMNSLR GEDTAVYFCA (SEQ ID NO: 741) | EVQLLE SGGGL VQPGG SLRLSC AAS (SEQ ID NO: 742) | GFTLG DYS (SEQ ID NO: 743) | MTWVR QAPGK GLEWV SS (SEQ ID NO: 744) | IRKSGGD T (SEQ ID NO: 745) | FYTDSV KGRFTI SRDTP KNTLFL QMNSL RGEDT AVYFC (SEQ ID NO: 746) | ARPTPY GTTWF GRVDS (SEQ ID NO: 747) | gaggtgcagctgttggagtctgggggaggcttggtacagcctggggggtccctgagactctcctgtgcagcctctggattcaccttaggtgactacagcatgacttgggtccgccaggctccagggaaggggctggagtgggtctcaagtattaggaaaagtggtggtgatacattctacacagactccgtgaagggccggttcaccatctccagagacacccccaagaacacgctgtttctgcaaatgaacagcctgagagccgaggacacggccgtgtattactgtgcagcaagaccgacaccgtatggcaccacttggtttggccgggatagctggggccaggggaccctggtcaccgtctcagcgtgcgaccgccaggactccccc (SEQ ID NO: 748) | EVQLLESGGGLV QPGGSLRLSCAA SGFTLGDYSMT WVRQAPGKGLE WVSSIRKSGGDT FYTDSVKGRFTIS RDTPKNTLFLQM NSLRGEDTAVYF CARPTPYGTTWF GRVDSWGQGTL VTVSS (SEQ ID NO: 749) | WGQG TLVTV SS (SEQ ID NO: 750) |
| 77 | 013-280L | DIQMTQSPSSL SASLGDRVTIT CRTSQSISNYL NWYQQKPGKA PKLLIYATSSLH SGVPSRFSGS GSGTDFTLTISS LQPEDFASYYC QQTYRT (SEQ ID NO: 751) | DIQMTQ SPSSLS ASLGD RVTITC RTS (SEQ ID NO: 752) | QSISNY (SEQ ID NO: 753) | LNWYQ QKPGK APKLLI Y (SEQ ID NO: 754) | ATS (SEQ ID NO: 755) | SLHSG VPSRFS GSGSG TDFTLTI SSLQPE DFASYY C (SEQ ID NO: 756) | QQTYR TPIT (SEQ ID NO: 757) | gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctacatccagtttgcataattggtgttcccatcaaggttcagtggcagtggatctgggacagatttcactctcaccatcagcagtctgcaacctgaagattttgcaagttactactgtcaacagacttacagaaccccaatcactttccgg (SEQ ID NO: 758) | DIQMTQSPSSLS ASLGDRVTITCRT SQSISNYLNWYQ QKPGKAPKLLIYA TSSLHSGVPSRF SGSGSGTDFTLTI SSLQPEDFASYY CQQTYRTPITFG PGTKVDIK (SEQ ID NO: 759) | FGPGT KVDIK (SEQ ID NO: 760) |

| Row | A Name | G V-REGION (1) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 86 | 019-2402H | QVQLVQSGAE VKRPGASLKVS CKASGYSFTTY GITWVRQAPG QGLEWMGWIS TYNGYTNYAQR LQGRVTMTTDT STGTAYLELRS LTYDDTAVYYC AR (SEQ ID NO: 841) | QVQLV QSGAE VKRPG ASLKVS CKAS (SEQ ID NO: 842) | GYSFTT YG (SEQ ID NO: 843) | ITWVRQ APGQG LEWMG W (SEQ ID NO: 844) | ISTYNGY T (SEQ ID NO: 845) | NYAQR LQGRV TMTTDT STGTAY LELRSL TYDDTA VYYC (SEQ ID NO: 846) | ARRGD YGDYR GDAFDI (SEQ ID NO: 847) | caggtgcagctggtgcagtctggagctgaggt tgaagaggcctggggcctcactcaaggtctcc tgcaaggcctctggttacagtttaccaccctac ggaatcacctggtgcgacagaccctggg caagggctggatgggatggatgagcagaga ctacaatggttacacaaactatgcacagaga cctcagggtgacactgactactgacacacagac acatccactggacctacagcctgagactga tgggtcctgacatatgacgacacgccgtctac ttattgtgcgagaacgtgggggactactacgga ggggacaatggccccgtcaccctcagtctccc ctctggtgcctgacatctgggtcagggtgacgg cctgggctgcctgacaaggacatactcgcc gacctgt (SEQ ID NO: 848) | QVQLVQSGAEVK RPGASLKVSCKA SGYSFTTYGITW VRQAPGQGLEW MGWISTYNGYTN YAQRLQGRVTM TTDTSTGTAYLEL RSLTYDDTAVYY CARRGDYGDYR GDAFDIWGQGT MVTVSS (SEQ ID NO: 849) | WGQG TMTTV SS |
| 87 | 019-2402L | DIQMTQSPSSL SASVGDRVTIT CQASQDVSNYL NWYQQKPGKA PKLLIYDTSNLE TGVPSRFSGTG SGTDFTFTISSL QPEDVATYFCQ Q (SEQ ID NO: 851) | DIQMTQ SPSSLS ASVGD RVTITC QAS (SEQ ID NO: 852) | QDVSN Y (SEQ ID NO: 853) | LNWYQ QKPGK APKLLI Y (SEQ ID NO: 854) | DTS (SEQ ID NO: 855) | NLETGV PSRFS GTGSG TDFTFT ISSLQP EDVATY FC (SEQ ID NO: 856) | QQVFT (SEQ ID NO: 857) | gacatccagatgacccagtctccatctccct gtctgcatctgtaggagacagagtcaccatca cttgccaggcgagtcaggacgttagcaactat taaattggtatcagcagaaaccagggaaag ccctaaactcctgatctacgataccatccaattt ggaaacaggtggccatcaaggttcagtggaa gtggatctggacagattacactttcaccatcaa cagcctgcagcctgaagattttgcaacttatta ctgtcaacaggtatttactggtccctggga accactgtgaaactggaagactctcagagaag tgctgaaaatcttcatcccgccatcagtaag gtcacagtggttcatcttgaaaagtggtgtgtc gaccagtgaagaagagagcctcacagaagc cagtaactccaagagagagtgcacagagc (SEQ ID NO: 858) | DIQMTQSPSSLS ASVGDRVTITC ASQDVSNYLNW YQQKPGKAPKLL IYDTSNLETGVPS RFSGTGSGTDFT FTISSLQPEDVAT YFCQQVFTSPG TKVDIK (SEQ ID NO: 859) | FGPGT KVDIK |

FIG. 12 (continued)

| Row | A Name | G V-REGION (1) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 88 | 019-2408H | EVQLVESGGGL VKPGGSLRLSC AASGFIFSDYT MNWVRQVPGK GLEWVSSISYS GYIYYADSVK GRFTLSRDNAK KSLYLQMNNLR AEDTAVYYCAK (SEQ ID NO: 861) | EVQLVE SGGGL VKPGG SLRLSC AAS (SEQ ID NO: 862) | GFIFSD YT (SEQ ID NO: 863) | MNWVR QVPGK GLEWV SS (SEQ ID NO: 864) | ISSYSGYI (SEQ ID NO: 865) | YYADS VKGRF TLSRDN AKKSLY LQMNN LRAEDT AVYYC (SEQ ID NO: 866) | AKDRV RDGDN DWDSV DATYW DATYW GYGVF DT (SEQ ID NO: 867) | gaggtgcagctggtggagtctgggggaggc ctggtcaagcctggggggtccctgagactc tcctgtgcagcctctggattcatatttagtgactatta catgaactgggtccgccaggttccagggaa ggggctggagtgggtctcaagtattagtagtta cagttactacatatacgcagactcaggtga aggccgattcaccatctccagagacaacgc caagaacctcactgtatctgcaaatgaacaac ctgagagccgaggacactgcggtgtatttactgtg tgaaggatagtgttgatactggacggacaag tgactggggatacttcgatacctggggccaagg gaccacggtcaccgtctcctcaggggcggcgtaatc aagcatcactccaatggggtcccagacgctctg gcc (SEQ ID NO: 868) | EVQLVESGGGLV KPGGSLRLSCAA SGFIFSDYTMNW VRQVPGKGLEW VSSISYSGYIYY ADSVKGRFTLSR DNAKKSLYLQMN NLRAEDTAVYYC AKDRVRDGDND WDSVDATYWGY GVFDTSGGGTM VTVSS (SEQ ID NO: 869) | SGQGT MVTVS S (SEQ ID NO: 870) |
| 89 | 012-2408L | DIVMTQSPDSL AVSLGERATIN CKSSQSVLYGS NMKNYFAWYQ QKPGQPPKMLI YWASTRESGV PDRFSGSGSG TDFTLTISSLQA EDVAVYYCQQ HYRIP (SEQ ID NO: 871) | DIVMTQ SPDSLA VSLGE RATINC KSS (SEQ ID NO: 872) | QSVLY GSNMK NY (SEQ ID NO: 873) | FAWYQ QKPGQ PPKMLI Y (SEQ ID NO: 874) | WAS (SEQ ID NO: 875) | TRESG VPDRF SGSGS GTDFTL TISSLQ AEDVA VYYC (SEQ ID NO: 876) | QQHYRI PQT (SEQ ID NO: 877) | gacatcgtgatgacccagtctccagactccct ggctgtgtctctgggcgagagggccaccatc aactgcaagtccagccagagtgttgttatacga gctccaacaataagaactacttcgcttggtaccaa cagaaaccaggacagcctcctaagatgct catttactgggcatctacccgggaatccggg gtccctgaccgattcactctcactcgtggcaggcg gcagtttcacttcactctcaccatcagcagcctgcaa gctgaagatgtggcagtttattactgtcagcaa cactatagaatttcctcagacgttcggccaagg gaccaaggtggaaatcaaacgtacggtgg ctgcaccatctgttttcatcttccccgccatctgat gagcagttgaaatctggaactgctctcgtgtgt gcctgctgaataactctcagagagaggcc aaagtacagtggaaggtggataacgccctc caatcgggtaactcccaggagagtgtcacagagc aggacagcaaggacagcacctacagcctca gcagcaccctgacgctgagcaaagcagactac gagaaacacaaagtctacgcctgcgaagtcacc catcagggcctgagctcgccgtcacaaagagctttcaacaggggagagtgttag (SEQ ID NO: 878) | DIVMTQSPDSLA VSLGERATINCK SSQSVLYGSNMK NYFAWYQQKPG QPPKMLIYWAST RESGVPDRFSGS GSGTDFTLTISSL QAEDVAVYYCQ QHYRIPQTFGQG TKVEIK (SEQ ID NO: 879) | FGQGT KVEIK (SEQ ID NO: 880) |

FIG. 12 (continued)

| Row | Name | V-REGION (I) | FR1-IMGT | CDR1-IMGT | FR2-IMGT | CDR2-IMGT | FR3-IMGT | CDR3-IMGT | Sequences | Translated sequence (V-REGION) | FR4-IMGT |
|---|---|---|---|---|---|---|---|---|---|---|---|
| 90 | 019-2408H | EVQLVESGGGL VQPGGSLRLSC AASGFSFSSFW MHWVRQVPGK GLLWVARINMD GTFTTYADSVK GRFTISRDNAK NTLMLHMSNLR VEDSALYFCVR (SEQ ID NO: 881) | EVQLVE SGGGL VQPGG SLRLSC AAS (SEQ ID NO: 882) | GFSFSS FW (SEQ ID NO: 883) | MHWVR QVPGK GLLWV AR (SEQ ID NO: 884) | INMDGTF T (SEQ ID NO: 885) | TYADSV KGRFTI SRDNA KNTLML HMSNL RVEDS ALYFC (SEQ ID NO: 886) | VRDND YGDYR GNAFDI (SEQ ID NO: 887) | gaggtgcagctggtggagtctgggggaggcttggtccagcctggggggtccctgagactctcctgtgcagcctctggattctcctttagtagcttctggatgcactgggtccgccaggttccagggaaggggctggagtgggttgcacgtataaatatggatggtacattcacaacatacgccgactctgtgaagggccgattcaccatctccagagacaacgccaagaatacgctgatgcttcatatgagcaacctgagagctgaggacagcgctttgtatttttgtgtcagagggaatgtccggcgtctttccctggtcacagcagacttccccaggtgcgctggaggacccggtgctttccctctgctggtgcacagagtggaggactacagaggcaacgcgttttgatatctggggccaaggaaccctggtcaccgtctcctcag (SEQ ID NO: 888) | EVQLVESGGGLV QPGGSLRLSCAA SGFSFSSFWMH WVRQVPGKGLL WVARINMDGTFT TYADSVKGRFTIS RDNAKNTLMLHM SNLRVEDSALYF CVRDNDYGDYR GNAFDIWGQGT MVTVSS (SEQ ID NO: 889) | WGQG TMVTV SS (SEQ ID NO: 890) |
| 91 | 019-2408L | DIQMTQSPSSL SASVGDRVTIT CQASQDMSNY LNWYQQKSGK APKLLIYDTSKL EAGVPSRFSGS GFGTHYVLSTS LQPEDIATYYC EQ (SEQ ID NO: 891) | DIQMTQ SPSSLS ASVGD RVTITC QAS (SEQ ID NO: 892) | QDMSN Y (SEQ ID NO: 893) | LNWYQ QKSGK APKLLI Y (SEQ ID NO: 894) | DTS (SEQ ID NO: 895) | KLEAGV PSRFS GSGFG THYVLS TSLQP EDIATY YC (SEQ ID NO: 896) | EQLHT (SEQ ID NO: 897) | gacatccagatgacccagtctccatcctcctgtctgcatctgtaggagacagagtcaccatcacttgccaggcgagtcaggacatgagcaactatttaaattggtatcagcagaaaccagggaaagcccctaagctcctgatctatgatacatccaagttggaaagtggggtcccatcaaggttcagtggaagtggatctgggacacattacgttctcacaatttgcacccagcaggacagcctgagtctgatggagctgggcgctgcagaagccttgtaaatgagcagttgtcatcttccagaagcccttaata (SEQ ID NO: 898) | DIQMTQSPSSLS ASVGDRVTITCQ ASQDMSNYLNW YQQKSGKAPKLL IYDTSKLEAGVPS RFSGSGFGTHYV LSTSLQPEDIATY YCEQLHTFGGG TKVEIK (SEQ ID NO: 899) | FGGGT KVEIK (SEQ ID NO: 900) |

| Row | Name | G (V-REGION (1)) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 96 | 019-4C01H | QVQLQESGPGLVKPSQTLSLTCSVSGDSMSGGFSWTWIRQHPGKGLEWIGSIYNGKIQFSLKSRLSMSVDTSKNQFSLKMSSVTGADTAVYFCAR (SEQ ID NO: 941) | QVQLQESGPGLVKPSQTLSLTCSVS (SEQ ID NO: 942) | GDSMSGGFS (SEQ ID NO: 943) | WTWIRQHPGKGLEWIGS (SEQ ID NO: 944) | ISYNGKI (SEQ ID NO: 945) | QFNPSLKSRLSMSVDTSKNQFSLKMSSVTGADTAVYC (SEQ ID NO: 946) | ARELGDYPYYAMDV (SEQ ID NO: 947) | caggtgcaactgcaggagtcgggcccagga cttggtgaagccttctcagacactgtccctcaccc tgcgtctctggtgactccatgagcggtggt tgtttcttggacctggatccgccagcaccca ggaagggcctggagtggattggatccatctat tatagtgggaaatccatcaactaccgtccctcc aagctcagtcgtttaagtatgtcagtggacacgtc atcaaaccagttctcctgaaaatgtccgtcta gtaactgaggacacagctgtctattactgtgct cgcgaagagctggggactactaccaatactcca tggtacggtcttctcctgaccgtctcaccctcccaag aggaccgtcctctccggtgaactactcccgaacctgtg gcctggtcaggaactactcccctgaacctgtg ac (SEQ ID NO: 948) | QVQLQESGPGLVKPSQTLSLTCSVSGDSMSGGFSWTWIRQHPGKGLEWIGSIYNGKIWGSISYNGKQFNPSLKSRLSMSVDTSKNQFSLKMSSVTGADTAVYFCARELGDYPYYAMDVWGQGTTVTVSS (SEQ ID NO: 949) | WGQGTTVTVSS (SEQ ID NO: 950) |
| 97 | 019-4C01L | DIQMTQSPSFLSASVGDRVTITCRASQGIASFLAWYQQKPGRAPNLLVYAASSLQTGVPSRFSGSGSGTEFTLTINSLQPEDFATYCQQVITFPRT (SEQ ID NO: 951) | DIQMTQSPSFLSASVGDRVTITCRAS (SEQ ID NO: 952) | QGIASF (SEQ ID NO: 953) | LAWYQQKPGRAPNLLVY (SEQ ID NO: 954) | AAS (SEQ ID NO: 955) | SLQTGVPSRFSGSGSGTEFTLTINSLQPEDFATYC (SEQ ID NO: 956) | QQVITFPRT (SEQ ID NO: 957) | gacatccagatgacccagtctccatcctccctg tctgcatctgtgggagacagagtcaccatcac ttgccgggcaagtcagggcattgccagttttta gcctggtatcaacaaaaaccagggagagcc cctaacctcctgatctatgctgcatccagtttgca aagtgggtcccatcaaggttcagtggaagtggat ctgggacagaattcactctcaccatcaac agcctacaacctgaagattttgcaacttactactgt caacaagttattacttttccctcggacgttc ggccaagggaccaaggtggaaatcaaacgt acggtggctgcaccatctgtcttcatcttcccgcca tctgatgagcagttgaaatctggaactgcct ctgttgtgtgcctgctgaataacttctatccca gagaggccaaagtacagtggaaggtggataa cgcctccaatcgggtaactcccaggagagt gtcacagagcaggacagcaaggacagcacc tacagcctcagcagcaccctgacgctgagcaaa gcagactacgagaaacacaaagtctacgcc (SEQ ID NO: 958) | DIQMTQSPSFLSASVGDRVTITCRASQGIASFLAWYQQKPGRAPNLLVYAASSLQTGVPSRFSGSGSGTEFTLTINSLQPEDFATYCQQVITFPRTFGQGTKVEIK (SEQ ID NO: 959) | FGQGTKVEIK (SEQ ID NO: 960) |

| Row | A Name | G V-REGION (1) | H FR1-IMGT | I CDR1-IMGT | J FR2-IMGT | K CDR2-IMGT | L FR3-IMGT | M CDR3-IMGT | N Sequences | Q Translated Sequence (V-REGION) | P FR4-IMGT |
|---|---|---|---|---|---|---|---|---|---|---|---|
| 100 | 012-4C03H | QVQLQESRPGLSCMRSYYWSWIRQSPGKGLEWIGYYYSGGTEYNPSLKSRVHSVDTSKNQFSLNLSSVSAADTAVYYCARGVSALVSVDYYYYMDV (SEQ ID NO: 981) | QVQLQESRPGLVKPSELVLSLSCTVS (SEQ ID NO: 982) | GGSMRSYY (SEQ ID NO: 983) | WSWIRQSPGKGLEWIG Y (SEQ ID NO: 984) | VYYSGGT (SEQ ID NO: 985) | EYNPSLKSRVHSVDTSKNQFSLNLSSVSAADTAVYYC (SEQ ID NO: 986) | ARGVSALVSVDYYYYMDV (SEQ ID NO: 987) | caggtgcagctgcaggagtcgggaccaggactggtgaagccttcggagaccctgtcctagactgtctgtatgtatcccacatagaactaccatagacataaccataccataccatagacata (SEQ ID NO: 988) | QVQLQESRPGLVKPSELVLSLSCTVSGGSMRSYYWSWIRQSPGKGLEWIGYYYSGGTEYNPSLKSRVHSVDTSKNQFSLNLSSVSAADTAVYYCARGVSALVSVDYYYYMDVWGKGTTVTVSS (SEQ ID NO: 989) | WGKGTTVTVSS (SEQ ID NO: 990) |
| 101 | 012-4C03L | SYELTQPPSVSVAPGKTAITCGGNNIGSKSVHWYQRKPGQAPVLVIYMRDRPSGIPERFSGSNSGNTATLTISRVEAGDEADYYCQVWDRNDPHF (SEQ ID NO: 991) | SYELTQPPSVSVAPGKTAITCGN (SEQ ID NO: 992) | NIGSKS (SEQ ID NO: 993) | VQWYQRKPGQAPVLVIY (SEQ ID NO: 994) | YMR (SEQ ID NO: 995) | DRPSGIPERFSGSNSGNTATLTISRVEAGDEADYYC (SEQ ID NO: 996) | QVWDRNDPH (SEQ ID NO: 997) | tcctatgagctgacacagccaccctcagtg... (SEQ ID NO: 998) | SYELTQPPSVSVAPGKTAITCGGNNIGSKSVQWYQRKPGQAPVLVIYMRDRPSGIPERFSGSNSGNTATLTISRVEAGDEADYYCQVWDRNDPHFGTGTEVTVL (SEQ ID NO: 999) | FGTGTEVTVL (SEQ ID NO: 1000) |

FIG. 12 (continued)

| Row | A Name | G V.REGION (1) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 102 | 018-4D01H | QVQLQESGPGLVKPSETLSLTCTVSGGSISTYYWTWIRQSPGKGLEWIGYVYYTGGTEYNSSLKSRVTISVDTSKNQFSLKLNSATAADTAVYYCARAVSTLVSVDYYFYV (SEQ ID NO: 1001) | QVQLQESGPGLVKPSETLSLTCTVS (SEQ ID NO: 1002) | GGSISTYY (SEQ ID NO: 1003) | WTWIRQSPGKGLEWIG (SEQ ID NO: 1004) | VYYTGGT (SEQ ID NO: 1005) | EYNSSLKSRVTISVDTSKNQFSLKLNSATAADTAVYYC (SEQ ID NO: 1026) | ARAVSTLVSVDYYFYV (SEQ ID NO: 1007) | caggtgcagctgcaggagtcgggcccagga ctggtgaagccttcggagaccctgtccctcac ctgcactgtctctggtggctccatcagtacttact actggacctggatccgccagtccccaggga aggggactggagtggattgggtatgtttattaca caggaagcaccgagtacaactccagcctcaa gagtcgagtcaccatatcagtagacacgtcca agaaccagttctccctgaagctgaactctgtga ccgctgcggacacggccgttatactactgtgc gagagcagttgtaactctggttagtgttgactat tacttctactactacgtctggggccaagggacc acggtcaccgtctccagtgactacttctactact (SEQ ID NO: 1008) | QVQLQESGPGLV KPSETLSLTCTVS GGSISTYYWTWI RQSPGKGLEWIG YVYYTGGTEYNS SLKSRVTISVDTS KNQFSLKLNSAT AADTAVYYCARA VSTLVSVDYYFY VYDVWGKGTTVT VSS (SEQ ID NO: 1009) | WGKG TTVTV SS (SEQ ID NO: 1010) |
| 103 | 018-4D01L | SYELTQPPSVSLAPGKTATITCGNNIGSKSVHWYQQKPGQAPVLVIYHNNRPTGIPERFSGSNSGNTATLTISRAAGDEAEYFCQVWDRND (SEQ ID NO: 1011) | SYELTQPPSVSLAPGKTATITCG N (SEQ ID NO: 1012) | NIGSKSVY (SEQ ID NO: 1013) | VHWYQQKPGQAPVLVIY (SEQ ID NO: 1014) | HNN (SEQ ID NO: 1015) | WRPTGIPERFSGSNSGNTATLTISRAAGDEAEYFC (SEQ ID NO: 1016) | QVWDRNNDPL (SEQ ID NO: 1017) | tcctatgagctgacacagccacctcagtgtc ctgtgcccccaggacagacggccaggatcac ctgtgggggaaacaacattggaagtaaaagt gtgcactggtatcagcagaagccaggccaagt cccctgtgctggtcatctattataataataataatc ggccctcaggatcctgagcgattctctggc tccaactctgggaacacggccaccctgacc atcagcaggcccagcgggtgaggacgaagct gagtactactgtcagtcctgggacgaccaagact gatccccccttcggggaactggaccaagagett gtcactgttccccaccttgtgcgtgacgcagaag taagtgacttctaccagagccgtgcgtggaagagtt ccctggagccgatccagggagtcccgtcaag agaggaggtgaa (SEQ ID NO: 1018) | SYELTQPPSVSL APGKTATITCGG NNIGSKSVHWYQ QKPGQAPVLVIY HNNRPTGIPER FSGSNSGNTATL TISRAAGDEAE YFCQVWDRNND PLFGTGTKVTVL (SEQ ID NO: 1019) | FGTGT KVTVL (SEQ ID NO: 1020) |

| Row | Name | V REGION (1) | FR1 IMGT | CDR1 IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 110 | 018-4F03H | QLQLQESGPGL VKPSETLSLICS VSGDSMSCSS CYWGWRQPP GKGLEYIGSSH YTGRTSHMPSL KSRVTISVDTSK RQLSRLSSVT AADTAVYYCAR (SEQ ID NO: 1081) | QLQLQ ESGPG LVKPSE TLSLC SVS (SEQ ID NO: 1082) | GDSMS CSSCY (SEQ ID NO: 1083) | WGWIR QPPGK GLEYIG S (SEQ ID NO: 1084) | SHYTGR T (SEQ ID NO: 1085) | SHMPSL KSRVTI SVDTSK RQLSLR SSVTA ADTAVY YC (SEQ ID NO: 1086) | ARLFGE LVGYQ AFDF (SEQ ID NO: 1087) | cagstgcagctgcagagtcagagtccggaccagggctctgtcaagccctccgagaccctgtctctcattg tcagtgtctggtgactccatgagctgtagta gctactgggctggatcgccagccccca ggaaggggcttggagtggatcgggagtccc atatactggcgcactccacaatgccctct ctcaaaagtcgagtcacctttccgtgaca gtgtcaaagcgccagtctccctaagctggc tactgagactgtggactacgtgctattac tgtgcgagactttgggttctagaccaagg cccgttctttgattctggggccaaggcccc accgtctccctcagccgtccggcccgaacctgtga (SEQ ID NO: 1088) | QLQLQESGPGLV KPSETLSLICSVS GDSMSCSSCYW GWRQPPGKGLE YIGSSHYTGRTS HMPSLKSRVTISV DTSKRQLSRLS SVTAADTAVYYC ARLFGELVGYQA FDFWGLGTMVT VSS (SEQ ID NO: 1089) | WGLGT MVTVS S (SEQ ID NO: 1090) |
| 111 | 018-4F03L | QSVLTQPPSAS GTPGQRVTISC SGSSSNIGSNS VNWYQQLPGT APKLLIFSNNER PSGVPDRFSGS KSGTSASLAIS GLQSEDEADYY CAAWDDSLDG (SEQ ID NO: 1091) | QSVLT QPPSA SGTPG QRVTIS CSGS (SEQ ID NO: 1092) | SSNIGS NS (SEQ ID NO: 1093) | VNWYQ QLPGT APKLLIF (SEQ ID NO: 1094) | SNN (SEQ ID NO: 1095) | ERPSG VPDRF SGSKS GTSASL AISGLQ SEDEA DYYC (SEQ ID NO: 1096) | AAWDD SLDGY V (SEQ ID NO: 1097) | cagtctgtgctgactcagccaccctcagcctctgcc gggtccccgggccagagggtcaccatctct tgttctggaagcagctccaacatcggaagtaat tctgtaactggtaccagcaactcccagaa caaggcccccaaactcctcatttattagtaataatca gccggccctcaggggtccctgaccgattctctg gctccaagtctggcacctcagcctccctgc ccagtggaccctgaggtgtctggaggagctgca tactactgtgcagcatgggatgacagcctggg tggtgtctggggcaggagggaccaagctg acgctaggcctggcaggcaggaggccctccacc atccagccgccttctcaaggagctgacaagaacagca cagcctgtgtgctcgtactacctggagagagctcccgtg cagg (SEQ ID NO: 1098) | QSVLTQPPSASG TPGQRVTISCSG SSNIGSNSVNW YQQLPGTAPKLLI FSNNERPSGVPD RFSGSKSGTSAS LAISGLQSEDEA DYYCAAWDDSL DGYVFDSGTKVT VL (SEQ ID NO: 1099) | FGSGT KVTVL (SEQ ID NO: 1100) |

| Row | A Name | G V-REGION (11) | H FR1 IMGT | I CDR1-IMGT | J FR2 IMGT | K CDR2 IMGT | L FR3 IMGT | M CDR3 IMGT | N Sequences | O Translated Sequence (V-REGION) | P FR4 IMGT |
|---|---|---|---|---|---|---|---|---|---|---|---|
| 114 | 019-4G05H | EVQLVESGGDL VQPGGSLRLSC AGSGFTFSSS WMHWVRQAP GKGLVWVSRIN SGGNFKKYADS VRGRFTISRDN TRNTLYLHMSS LRHEDTALYYC AR (SEQ ID NO: 1121) | EVQLVE SGGDL VQPGG SLRLSC AGS (SEQ ID NO: 1122) | GFTFSS SW (SEQ ID NO: 1123) | MHWVR QAPGK GLVWV SR (SEQ ID NO: 1124) | INSGGNF K (SEQ ID NO: 1125) | KYADS VRGRF TISRDN TRNTLY LHMSS LRHEDT ALYYC (SEQ ID NO: 1126) | ARDHD YGDYR GNAYDI (SEQ ID NO: 1127) | gaggtgcagctggtggaagtgggggaggc ttagttcagcctggggggtccctgagactc tcctgtgcagcgtctggattcacctttagttcc agttggatgcactgggtccgccaggctccagga aaggggctggagtgggtctcacgtattaatagtg gtggtaattttaaaaaatactatgctgattctgtg aaaggccgattcaccatctccagagacaac accaggaacacgctgtatctgcatatgagca gcctgagacatgaggacacggctacgtattactgt gcgagagcggtcccatgaccgctatgggggcc cagagaactctggggcagcaccctccagg tgcctcctggtcaagggatactctccccg cctgtg (SEQ ID NO: 1128) | EVQLVESGGDLV QPGGSLRLSCAG SGFTFSSSWMH WVRQAPGKGLV WVSRINSGGNFK KYADSVRGRFTI SRDNTRNTLYLH MSSLRHEDTALY YCARDHDYGDY RGNAYDIWGQG TMVTVSS (SEQ ID NO: 1129) | WGQG TMVTV SS (SEQ ID NO: 1130) |
| 115 | 019-4G05L | DIQMTQSPSSL SASVGDRVTIT CQASQDISNYF NWYQQKPGKA PKLLIFDTSKLE TGVPSRFSGR QSGTDYTFTIS SLQPEDIATYFC QQ (SEQ ID NO: 1131) | DIQMTQ SPSSLS ASVGD RVTITC QAS (SEQ ID NO: 1132) | QQDISNY (SEQ ID NO: 1133) | FNWYQ QKPGK APKLLIF (SEQ ID NO: 1134) | DTS (SEQ ID NO: 1135) | KLETGV PSRFS GRQSG TDYTFT ISSLQP EDIATY FC (SEQ ID NO: 1136) | QQLDS (SEQ ID NO: 1137) | gacatccagatgacccagtctccatcctcct gtctgcatctgtaggagacagagtcaccatca cttgccagcgagtcaggacagtccataatat ttaattggtatcagcagaaaccagggaaag cccctaagctcctgatctttgatacatccaagtt gcaaacaggggtcccatcaaggttcagtgga gcagcatctgggacagatttcacttcaccatc agcagcctgcagcctgaagatgttgcaactt attgtcagcagcttgatagttggcggacgttcg gccaggggaccaagctggagatcaaacgaactgtggct gcaactgtcttctctttccagccaatggagctg agcaggtgaaaactcatatccccgagaggcca aagtagttcctccagagagacaggtgcacaagag c (SEQ ID NO: 1138) | DIQMTQSPSSLS ASVGDRVTITCQ ASQDISNYFNWY QQKPGKAPKLLIF DTSKLETGVPSR FSGRQSGTDYTF TISSLQPEDIATY FCQQLDSFGGG TKVEIK (SEQ ID NO: 1139) | FGGGT KVEIK (SEQ ID NO: 1140) |

| Row | Name | V-REGION (1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
|---|---|---|---|---|---|---|---|---|---|---|---|
| 118 | 02D-3B04H | EVQLLESGGGL VQPGGSLRLSC AASGFTFSDYA MSWVRQAPGK GLEWVSGISGR GDSTYYADSVK GRFTISRDNSQ NTLYLQMISLRA EDTAEYYCAK EDTAEYYCAK (SEQ ID NO: 1161) | EVQLLE SGGGL VQPGG SLRLSC AAS (SEQ ID NO: 1162) | GFTFSD YA (SEQ ID NO: 1163) | MSWVR QAPGK GLEWV SG (SEQ ID NO: 1164) | ISGRGDS T (SEQ ID NO: 1165) | YYADS VKGRF TISRDN SQNTLY LQMISL RAEDT AEYYC (SEQ ID NO: 1166) | AKDHR G (SEQ ID NO: 1167) | gaggtgcagctgttggagtctgggggaggcttg gtacagcctggggggtccctgagactctcctgtgc agcctctggattcaccttcagtgactatgc catgagctgggtccgccaggctccagggaa ggggctggagtgggtctcaggtattagtggtcgtg gtgattacacatactatgcagactccgtg aagggccggttcaccatctccagagacaatgcg aagaacacgctgtatctgcaaatgagcag tctgagagccgaggacacggccgaatatta ctgtgcgaaagatcacaggggctgggccaccccgc cccaaggaccctggtctctcccctgggacagtgg ctcaaggcccaagctccacactctctggggacacagtgg cccctggtggtccctgggacacagtggtgtccagcctccaa cctgg (SEQ ID NO: 1168) | EVQLLESGGGLV QPGGSLRLSCAA SGFTFSDYAMS WVRQAPGKGLE WVSGISGRGDST YYADSVKGRFTI SRDNSQNTLYLQ MISLRAEDTAEY YCAKDHRGWGQ GTLVTVSS (SEQ ID NO: 1169) | WGQG TLVTV SS (SEQ ID NO: 1170) |
| 119 | 02D-3B04L | DIQMTQSPSSL SASVGDRVTIT CQASQDISNYL NWYQQKSGKA PKLLIYDASNLD QSGVPSRFSGSG SGTDFTFTISSL QPEDFATYYCQ QFDKFP (SEQ ID NO: 1171) | DIQMTQ SPSSLS ASVGD RVTITC QAS (SEQ ID NO: 1172) | QQISNY (SEQ ID NO: 1173) | LNWYQ QKSGK APKLLI Y (SEQ ID NO: 1174) | DAS (SEQ ID NO: 1175) | NLDTG VPSRFS GSGSG TDFTFT ISSLQP EDFATY YC (SEQ ID NO: 1176) | QQFDK FPWT (SEQ ID NO: 1177) | gacatccagatgacccagtctccatcctccct gtctgcatctgtaggagacagagtcaccatca cttgccaggcgagtcaggacattagcaactat ttaaattggtatcagcagaaaccagggaaag cccctaagctcctgatctatgatgcatccaattt ggatacagcgggggtcccatcaaggttcagtgga agtggatctgggacagattttactttcaccatca gcagcctgcagcctgaagattttgcaacttact actgtcaacagtttgataaattaacctggaactg gccttgggaccaaggtgggaaatcaaac gcctgtggctgcctgagcagttgaaatcgaactgg (SEQ ID NO: 1178) | DIQMTQSPSSLS ASVGDRVTITCQ ASQDISNYLNWY QQKSGKAPKLLI YDASNLDTGVPS RFSGSGSGTDFT FTISSLQPEDFAT YYCQQFDKFPW TFGQGTKVEIK (SEQ ID NO: 1179) | FGQGT KVEIK (SEQ ID NO: 1180) |

| Row | A Name | G V REGION (1) | H FR1 IMGT | I CDR1 IMGT | J FR2 IMGT | K CDR2 IMGT | L FR3 IMGT | M CDR3 IMGT | N Sequence | O Translated Sequence V REGION | P FR4 IMGT |
|---|---|---|---|---|---|---|---|---|---|---|---|
| 122 | 020-3F0H | QVQLVESGGG VVQPGRSLRLS CAASGFSFSNY GIHWVRQAQG KGLEWVAVISH TGSNKYYADSV KGRFTISRDNS KMMLYLQMNSL RVEDTAVYYCA (SEQ ID NO: 1201) | QVQLV ESGGG VVQPG RSLRLS CAAS (SEQ ID NO: 1202) | GFSFS NYG (SEQ ID NO: 1203) | IHWVR QAQGK GLEWV AV (SEQ ID NO: 1204) | ISHTGSN K (SEQ ID NO: 1205) | YYADS VKGRF TISRDN SKMML YLQMN SLRVED TAVYYC (SEQ ID NO: 1206) | ATLGG DWLEP GTRSD YYYGL DV (SEQ ID NO: 1207) | caggtccagctggtggagtctgggggaggc gtggtccagcctggcaggtccctgagactc tgtgcagcctctggattcagtttcagtaactatgg gcataacactgggtccgccaggctcaaggga aggggctggagtgggtggcagttatataacaa cactggaagtaataaatattacgcagactccgt gaagggccgattcaccatctccagagacaat tccaagaacacgctgtatctgcaaatgaacagc ctgagagtcgaggacacggctgtgtattactgt gcgaagacggctctggggggactactactgtac gcctggacggtactactactattacggtttgg acgtctggggccaagggaccacggtcaccg tctcctcagcactcctccatcccactcacctcc (SEQ ID NO: 1208) | QVQLVESGGGV VQPGRSLRLSCA ASGFSFSNYGIH WVRQAQGKGLE WVAVISHTGSNK YYADSVKGRFTI SRDNSKMMLYLQ MNSLRVEDTAVY YCATLGGDWLEP GTRSDYYYGLDV WGQGTTVTVSS (SEQ ID NO: 1209) | WGQG TTVTV SS (SEQ ID NO: 1210) |
| 123 | 020-3F04 | DIQMTQSPSTL SASVGDRVTIT CRASQSISTWL AWYQQKPGKA PNLLIYKASSLK SGVPSRFSGS GSGTDFTLTISS LQPDDFATYYC QQYYTNS (SEQ ID NO: 1211) | DIQMTQ SPSTLS ASVGD RVTITC RAS (SEQ ID NO: 1212) | QSISTW LA (SEQ ID NO: 1213) | LAWYQ QKPGK APNLLI Y (SEQ ID NO: 1214) | KAS (SEQ ID NO: 1215) | SLKSGV PSRFS GSGSG TDFTLTI SSLQP DDFATY YC (SEQ ID NO: 1216) | QQYYT NSRM (SEQ ID NO: 1217) | gacatccagatgacccagtctccatcctccctg tctgcatctgtaggagacagagtcaccatcact tgccgggcgagtcagagtattagtacttggtta gcctggtaccagcagaaaccagggaaagccc ctaacctcctgatctataaggcgtccagtttag aaagtggggtcccatcaaggttcagcggcag tggatctgggacagacttcactctcaccatcagc agtctacaacctgaagattttgcaacttactac tgtcaacagtattatacctaccctccatttacta ttcggccaagggacacgactggagattaaac gaactgtggctgcaccatctgtcttcatcttc (SEQ ID NO: 1218) | DIQMTQSPSTLS ASVGDRVTITCR ASQSISTWLAWY QQKPGKAPNLLI YKASSLKSGVPS RFSGSGSGTDFT LTISSLQPDDFAT YYCQQYYTNSR MFGQGTKVEIK (SEQ ID NO: 1219) | FGQGT KVEIK (SEQ ID NO: 1220) |

FIG. 12 (continued)

| Row | A Name | G V-REGION (1) | H FR1-IMGT | I CDR1-IMGT | J FR2-IMGT | K CDR2-IMGT | L FR3-IMGT | M CDR3-IMGT | N Sequence | O Translated Sequence (V-REGION) | P FR4-IMGT |
|---|---|---|---|---|---|---|---|---|---|---|---|
| 124 | 020-2G08H | QVQLVESGGG LVKPGGSLRLS CAASGFNFSDY YMSWRQAPG KRLEWVSYSS SGDNTLYADSM RGRFTISRDNA KKSLYLQLSSL RAEDTAVFYCA R (SEQ ID NO: 1221) | QVQLV ESGGG LVKPG GSLRLS CAAS (SEQ ID NO: 1222) | GFNFS DYY (SEQ ID NO: 1223) | MSWIR QAPGK RLEWV SY (SEQ ID NO: 1224) | ISSSGDN T (SEQ ID NO: 1225) | LYADS MRGRF TISRDN AKKSLY LQLSSL RAEDT AVFYC (SEQ ID NO: 1226) | ARASA YYYDS SGRAA AFDI (SEQ ID NO: 1227) | cagtgcagctgttggagtctgggggaggct tggtcaagcctgagggtcctgagactcg tgtgcagcctctggattcaacttcagtgacta catgagctggctggtccgccaggctccaggga agcggctggagtgggtttcatacatcagcagt agtggtgataacacctactacgcagactcc atgcggggccgattcaccatctccagagaca ataagaagagccctgtatctgcaattgagcagc ctgagagctgaggacacggcgtgtattact tgtgcgagagcgagtgctactattatgatagcagt ggtgccgccgccttcgatatctggggccaa gggacaacggtcaccgtctctcagtgac (SEQ ID NO: 1228) | QVQLVESGGGLVQQG KPGGSLRLSCAA SGFNFSDYYMS WRQAPGKRLE WVSYSSSGDNT LYADSMRGRFTI SRDNAKKSLYLQ LSSLRAEDTAVF YCARASAYYYDS SGRAAAFDIWGQ GTRVTVSS (SEQ ID NO: 1229) | FGPGT TRVTV SS (SEQ ID NO: 1230) |
| 125 | 020-2G08L | DIVMTQSPLSL PVTPGEPASIS CRSSQSLLHSN GYNYLEWYVQ KPGQSPQLLIYL GSMRASSGVPD RFSGSGSGRD FTLKISRVEAED VGVYYCMQVL QTP (SEQ ID NO: 1231) | DIVMTQ SPLSLP VTPGE PASISC RSS (SEQ ID NO: 1232) | QSLLHS NGYNY (SEQ ID NO: 1233) | LEWYV QKPGQ SPQLLI Y (SEQ ID NO: 1234) | LGS (SEQ ID NO: 1235) | MRASG VPDRF SGSGS GRDFTL KISRVE AEDVG VYYC (SEQ ID NO: 1236) | MQVLQ TPLFT (SEQ ID NO: 1237) | gatattgtgatgacccagtctcccctctccctg cccgtcacccctggagaaccggcctccatctcc tgcaggtctagtcagagcctcctacatagtaat ggatacaactatttggagtggtacgtgcagaa gccaggacagtctccacagctcctgatctatt tgggttctaatcgggcctccggggtccctgaca ggttcagtggcagtggatcaggcacagattttt acactgaaaatcagcagagtggaggctgag gatgtgggagtttattactgcatgcaagttcaa acacctccatcccgccacctgtgctgcacc (SEQ ID NO: 1238) | DIVMTQSPLSLPV TPGEPAS/SCRS SQSLLHSNGYNY LEWYVQKPGQS PQLLYLGSNRAS GVPDRFSGSGS GRDFTLKISRVEA EDVGVYYCMQV LQTPLFTFGPGT KVDIK (SEQ ID NO: 1239) | FGPGT KVDIK (SEQ ID NO: 1240) |

FIG. 12 (continued)

| Row | Name | V-REGION (1) | FR1-IMGT | CDR1-IMGT | FR2-IMGT | CDR2-IMGT | FR3-IMGT | CDR3-IMGT | Sequence | Translated Sequence (V-REGION) | FR4-IMGT |
|---|---|---|---|---|---|---|---|---|---|---|---|
| 126 | 014-24041 | QVQLQESGPGLVKPSQTLSLTCNVSGGSISSGSSYYWSWIRQPAGKGLEWIGRLYTSGTTNYNPSLKSRVTMSVDTSKNQFSLKLSSVTAADTAVYYCAR (SEQ ID NO: 1241) | QVQLQESGPGLVKPSQTLSLSCNVS (SEQ ID NO: 1242) | GGSISSGSYY (SEQ ID NO: 1243) | WSWIRQPAGKGLEWIGR (SEQ ID NO: 1244) | LYTSGTT (SEQ ID NO: 1245) | NYNPSLKSRVTMSVDTSKNQFSLKLSSVTAADTAVYYC (SEQ ID NO: 1246) | ARGIKGDYGGG ANWFDP (SEQ ID NO: 1247) | caggtacagctgcagcagtcaggaccaggactggtgaagccctcacatcacc ctgcactgtctctggtggctccatcagcagtggtagttactactggagctggatccgg cagcccgcagggaagggactggagtggattgggcgtctctattatactagtggg accacctacaacccgtccctcaagagtcgagtcaccatgtcagtagacacgtcc aagaaccagttctccctgaagctgagctctgtgaccgccgcagacacggccgtg tattactgtg (SEQ ID NO: 1248) | QVQLQESGPGLVKPSQTLSLSCNVSGGSISSGSYYWSWIRQPAGKGLEWIGRLYTSGTTNYNPSLKSRVTMSVDTSKNQFSLKLSSVTAADTAVYYCARGIKGDYGGGANWFDPWGQGTLVTVSS (SEQ ID NO: 1249) | WGQGTLVTVSS (SEQ ID NO: 1250) |
| 127 | 014-24041 | EIVMTQSPATLSVSPGERATLSCRASQSVSSNLAWYQQKPGQAPRLLIYRASTRATGIPARFSGSGSGTEFTLTISSLQSEDFAVYYCQQYNNWPP (SEQ ID NO: 1251) | EIVMTQSPATLSVSPGERATLSCRAS (SEQ ID NO: 1252) | QSVSSN (SEQ ID NO: 1253) | LAWYQQKPGQAPRLLIY (SEQ ID NO: 1254) | RAS (SEQ ID NO: 1255) | TRATGIPARFSGSGSGTEFTLTISSLQSEDFAVYYC (SEQ ID NO: 1256) | QQYNNWPPYT (SEQ ID NO: 1257) | gaaattgtgatgacgcagtctccagccaccctgtctgtgtctccaggggaaaga gccaccctctcctgcagggccagtcagagtgttagcagcaacttagcctggtacc agcagaaacctggccaggctcccaggctcctcatctataggcgcatccaccagggccactggtatcccagccaggttcagtggcagtgggtctgggacagagttcactctcaccatcagcagcctacagtctgaagattttgcagtttattactgtcagcagtataataactggccgtacacttt (SEQ ID NO: 1258) | EIVMTQSPATLSVSPGERATLSCRASQSVSSNLAWYQQKPGQAPRLLIYRASTRATGIPARFSGSGSGTEFTLTISSLQSEDFAVYYCQQYNNWPPYTFGQGTKVEIK (SEQ ID NO: 1259) | FGQGTKVEIK (SEQ ID NO: 1260) |

| Row | Name | V REGION (1) | FR1 IMGT | CDR1 IMGT | FR2 IMGT | CDR2 IMGT | FR3 IMGT | CDR3 IMGT | Sequence | Translated Sequence (V-REGION) | FR4 IMGT |
|---|---|---|---|---|---|---|---|---|---|---|---|
| 132 | 015-2F03H | QVQLQESGPG LVKPSETLSLTC TVSTYSISSGYY WGWIRQPPGK GLEWIGSIYHS GTTYYNPSLKS RITTSVDTSKN QFSLKLTSVTA ADTAVYYCA (SEQ ID NO: 1301) | QVQLQ ESGPG LVKPSE TLSLTC TVS (SEQ ID NO: 1302) | TYSISS GYY (SEQ ID NO: 1303) | WGWIR QPPGK GLEWIG (SEQ ID NO: 1304) | IYHSGTT (SEQ ID NO: 1305) | YYNPSL KSRITT SVDTSK NQFSLK LTSVTA ADTAVY YC (SEQ ID NO: 1306) | ARVIVS TNYFD (SEQ ID NO: 1307) | gaaatggtgcagctcaggacctt gtttgtctcaggccccagtgggaaggccagcagcagctc ctgcaggccctgtactgcagcagcagaaacctagcagcagc tcttagctgctactcatcatctatcatagtggcagagcggcca aggccactggggatccaccaccaccgtttcagt ccagctgaccatggtccagacaccagccaggtttcaag catcagcagatgaggccctgaggtttcagg tgtataactgtcaggagtgggaccaaggttggagatc aactttgccaggggaccaaggtggagatc aaac (SEQ ID NO: 1308) | QVQLQESGPGLVWGQG KPSETLSLTCTVSTLVTV TYSISSGYYWGWISS IRQPPGKGLEWI (SEQ ID PSIYHSGTTYYN NO: PSLKSRITTSVDT 1310) SKNQFSLKLTSV TAADTAVYYCAR VIVSTNYFDDWG QGTLVTVSS (SEQ ID NO: 1309) | WGQG TLVTV SS (SEQ ID NO: 1310) |
| 133 | 015-2F03L | EIVLTQSPGTLS LSPGERATLSC RASQSVMSIYL AWYQQKPGQA PRVLIYGTSSR ATGIPDRFSGS GSGTDFTLTISR LEPEDFAVYYC QLYGGSPL (SEQ ID NO: 1311) | EIVLTQ SPGTLS LSPGE RATLSC RAS (SEQ ID NO: 1312) | QSVMSI Y (SEQ ID NO: 1313) | LAWYQ QKPGQ APRVLI Y (SEQ ID NO: 1314) | GTS (SEQ ID NO: 1315) | SRATGI PDRFS GSGSG TDFTLTI SRLEPE DFAVY YC (SEQ ID NO: 1316) | QLYGG SPLFA (SEQ ID NO: 1317) | gaggtcagctgtggagtctggggggaggctt ggtacagcctggggggtccctgagactctcct gtgcagcctctggattcaccttcactgctaatg ccatgaactgggtccgccaggctccagggaa ggggctggagtgggtctcaagattagtagtagt agtggtgataacacacacttacgcagactccg tgaagggccggttcaccatctccagagacaat tccaagaacacgctgtatctgcaaatgaaca gcctgagagccgaggacacggccgtgtattta ctgtgcgaaatccggcgggacgagcagggca ttgaccactggggccaagggaccacggtca cgtctcctcag (SEQ ID NO: 1318) | EIVLTQSPGTLSL FGPGT SPGERATLSCRA KVDIK SQSVMSIYLAWY (SEQ ID QQKPGQAPRVLI NO: YGTSSRATGIPD 1320) RFSGSGSGTDFT LTISRLEPEDFAV YYCQLYGGSPLF AFGPGTKVDIK (SEQ ID NO: 1319) | FGPGT KVDIK (SEQ ID NO: 1320) |

FIG. 12 (continued)

| Row | Name | V-REGION (1) | FR1-IMGT | CDR1-IMGT | FR2-IMGT | CDR2-IMGT | FR3-IMGT | CDR3-IMGT | Sequence | Translated Sequence V-REGION | FR4-IMGT |
|---|---|---|---|---|---|---|---|---|---|---|---|
| 134 | B20-2408H | EVQLLESGGGL VQPGGSLRLSC AASGFTFSSYA MSWVRQAGKGL EWVSTISGSGG STYYADSVKG RFTISRDNSK NTLYLQMNSLK AEDTAVYYCAK WP (SEQ ID NO: 1321) | EVQLLE SGGGLV QPGGS LRLSCA AS (SEQ ID NO: 1322) | GFTFSS YA (SEQ ID NO: 1323) | MSWVR QAQGK GLEWV ST (SEQ ID NO: 1324) | ISGSGGS T (SEQ ID NO: 1325) | YYADS VKGRF TISRDN SKNTLY LQMNS LKAEDT AVYYC (SEQ ID NO: 1326) | AKDPR SSVPW VAY (SEQ ID NO: 1327) | gaagtgcagctgttggagtctgggggaggcttggtccagcctggggggtccctgagactctcctgtgcagcctccggattcaccttcagcagctatgccatgagctgggtccgccaggctccagggaaggggctggagtgggtctcaactattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatccgagatcttctgtaccatgggtcgcctactaa (SEQ ID NO: 1328) | EVQLLESGGGLV QPGGSLRLSCAA SGFTFSSYAMS WVRQAGKGLE WVSTISGSGGST YYADSVKGRFTI SRDNSKNTLYLQ MNSLKAEDTAVY YCAKDPRSSVP WVAYWGQGTLV TVSS (SEQ ID NO: 1329) | WGQG TLVTV SS (SEQ ID NO: 1330) |
| 135 | B20-2404L | VMTQSPLSLPV TLGQPASISCR SSQSLVHSDGNT YLNWFQQRPG QSPRRLIYKV SNRDSGVPDR FSGSGSGTDFT LKISRVEAEDV GVYYCMQGTH WP (SEQ ID NO: 1331) | VMTQS PLSLPV TLGQP ASISCR SS (SEQ ID NO: 1332) | QSLVH SDGNT Y (SEQ ID NO: 1333) | LNWFQ QRPGQ SPRRLI Y (SEQ ID NO: 1334) | KVS (SEQ ID NO: 1335) | NRDSG VPDRF SGSGS GTDFTL KISRVE AEDVG VYYC (SEQ ID NO: 1336) | MQGTH WPPYT (SEQ ID NO: 1337) | gatgttgtgatgactcagtctccactctccctgcccgtcacccctggagagccggcctccatctcctgcaggtctagtcagagcctcgtacacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccgtacacgttcggccaaggaccaaggtggaaatcaaacgtctctca (SEQ ID NO: 1338) | VMTQSPLSLPVT LGQPASISCRSS QSLVHSDGNTYL NWFQQRPGQSP RRLIYKVSNRDS GVPDRFSGSGS GTDFTLKISRVEA EDVGVYYCMQG THWPPYTFGQG TKVEIK (SEQ ID NO: 1339) | FGQGT KVEIK (SEQ ID NO: 1340) |

| Row | Name | V-REGION (1) | FR1-IMGT | CDR1-IMGT | FR2-IMGT | CDR2-IMGT | FR3-IMGT | CDR3-IMGT | Sequence | Translated Sequence V-REGION | FR4-IMGT |
|---|---|---|---|---|---|---|---|---|---|---|---|
| 138 | B2B-268H | EVQLLESGGGL VQPGGSLRLSC AASGFTFSSYA MNWVRQAPGK GLEWVSAISGS GGSTYHADSVK GRFTISRDNSK NTLYLQMSSLR AEDTAVYYCAK (SEQ ID NO: 1361) | EVQLLE SGGGL VQPGG SLRLSC AAS (SEQ ID NO: 1362) | GFTFSS YA (SEQ ID NO: 1363) | MNWVR QAPGK GLEWV SA (SEQ ID NO: 1364) | ISGSGGS T (SEQ ID NO: 1365) | YHADS VKGRF TISRDN SKNTLY LQMSS LRAEDT AVYYC (SEQ ID NO: 1366) | AKSPAS SWYFD H (SEQ ID NO: 1367) | caggtgcagctgcaggagtcgggcccagga cgtgaagccttcggagaccctgtcctcac ctgcactgtctcactactacagcagtggt actactgggactggatccggcagcccccaggg aaggggctggagtggattggatatatctat gaatggggacaccaccacaacccgtccctc aagagacacgttctctctctgaactgcagttc ccagaacccggagaatctggtatattattg tgcagactgggactgtatgtcgcgataacttggttgagaatgcggg gatccg (SEQ ID NO: 1368) | EVQLLESGGGLV QPGGSLRLSCAA SGFTFSSYAMN WVRQAPGKGLE WVSAISGSGGST YHADSVKGRFTI SRDNSKNTLYLQ MSSLRAEDTAVY YCAKSPASSWYF DHWGQGTLVTV SS (SEQ ID NO: 1369) | WGQG TLVTV SS (SEQ ID NO: 1370) |
| 139 | B2B-268L | EIVMTQSPATL SVSPGERATLS CRASQSVSSNL AWYQQKPGQA PRLVIYGASTR ATGIPARFSGS GSGTEFTLTISS LQSEDFAVYYC QQDMNWPT (SEQ ID NO: 1371) | EIVMTQ SPATLS VSPGE RATLSC RAS (SEQ ID NO: 1372) | QSVSS N (SEQ ID NO: 1373) | LAWYQ QKPGQ APRLVI Y (SEQ ID NO: 1374) | GAS (SEQ ID NO: 1375) | TRATGI PARFS GSGSG TEFTLTI SSLQSE DFAVYY C (SEQ ID NO: 1376) | QQDMN WPTWT (SEQ ID NO: 1377) | gaaattgtgctgacgcagtccccagccaccct gtcttgtctcagggggagagccacactctc ctgcagggccagtcagagtgttagcagcaacttggcc tactagcctggtaccagcagaaacctggc aggcctcccaggctcctcatctatggtgcatccacca gccggagccactggcatcccagcaaggttta atggcagtgggtctgggacagagttcactctc accatatcactgtcagcctgaggattcgc agtgcttggttcggccctggaccgagtggcgtaagggata tcaaac (SEQ ID NO: 1378) | EIVMTQSPATLS VSPGERATLSCRA SQSVSSNLAWY QQKPGQAPRLVI YGASTRATGIPA RFSGSGSGTEFT LTISSLQSEDFAV YYCQQDMNWPT WTFGQGTKVEIK (SEQ ID NO: 1379) | FGQGT KVEIK (SEQ ID NO: 1380) |

| | Number | Age (years) | Female (%) | Interval after given 2009/10 TIV days) |
|---|---|---|---|---|
| Pandemic (H1N1) 2009 vaccine | 24 | 39.5 (26 - 64) | 79.2 | -77 (-4 to -160) |
| 2009/10 TIV | 27 | 29 (21 - 47) | 74.1 | N/A |

FIG. 14A

| | | | | | | | |
|---|---|---|---|---|---|---|---|
| 20-2A04H | IGHV3-03*01 | 9 | 97 | IGHJ4*02 | IGHD2-2*01 | 8.8.13 | CAKDPRGVFWVAYW |
| 20-2A04K | IGKV2-30*02 | 2 | 99 | IGKJ2*01 | | 11.3.10 | CMQGTHWPPYTF |
| 20-2B03H | IGHV3-23*01 | 13 | 95 | IGHJ4*02 | IGHD4-17*01 | 8.8.13 | CANRMGLRPDYFDYW |
| 20-2B03K | IGKV3-20*01 | 5 | 96 | IGKJ2*01 | | 7.3.9 | CQQYGTSAKTF |
| 20-2B05H | IGHV3-23*01 | 4 | 96 | IGHJ4*02 | IGHD6-13*01 | 8.8.13 | CAKSPASSWYFDHW |
| 20-2B05K | IGKV3-15*01 | 3 | 99 | IGKJ1*01 | | 6.3.10 | CQQDNNWPTWTF |
| 20-2C05H | IGHV4-30*01 | 9 | 97 | IGHJ5*02 | IGHD4-03*01 | 10.7.17 | CARHRVGTGPEVGCWFDPW |
| 20-2C05K | IGKV3-15*01 | 3 | 99 | IGKJ2*01 | | 6.3.11 | CQQYNSWPPMYTF |
| 20-2D03H | IGHV3-23*01 | 26 | 91 | IGHJ6*02 | IGHD3-10*01 | 8.8.13 | CRGWFGEGMGWDVW |
| 20-2D03K | IGKV2 or 20-28*01 | 11 | 96 | IGKJ2*01 | | 11.3.9 | CMQALQTPYWF |
| 20-3F04H | IGHV3-30*03 | 14 | 95 | IGHJ6*02 | IGHD2-2*01 | 8.8.23 | CATLGGDIVLEFGTRSDYYYGLDVW |
| 20-3F04K | IGKV1-5*03 | 13 | 96 | IGKJ1*01 | | 6.3.9 | CQQYYTNSRMF |
| 20-3G06H | IGHV3-11*01 | 18 | 94 | IGHJ3*02 | IGHD5-03*01 | 8.8.16 | CARAGAYYYDSSGRAAAFDIW |
| 20-3G06K | IGKV2-26*01 | 6 | 98 | IGKJ3*01 | | 11.3.10 | CMQVLQTPLFTF |

| Name | V-GENE | J-GENE | D-GENE | AA JUNCTION |
|---|---|---|---|---|
| 05-1D03H | IGHV5-51*01 | IGHJ6*02 | IGHD4-23*01 | CARHVASHWGDYYGMDLW |
| 05-1D03L | IGKV3-15*01 | IGKJ1*01 | | CQQYNDWLGGTF |
| 05-1D06H | IGHV4-31*06 | IGHJ4*02 | IGHD6-19*01 | CARGLEGITVGAYYFDFW |
| 05-1D06L | IGKV1-13*02 | IGKJ4*01 | | CQQFNSFPLTF |
| 05-1F02H | IGHV4-31*06 | IGHJ4*02 | IGHD6-19*01 | CARGLEGITVGVYYCDFW |
| 05-1F02L | IGKV1-13*02 | IGKJ4*01 | | CQQFNSYPLTF |
| 18-1B01H | IGHV3-30*03 or IGHV3-30*18 | IGHJ4*02 | IGHD2-8*02 | CARDQELVVLYYFDFW |
| 18-1B01L | IGLV3-21*02 | IGLJ2*01 or IGLJ3*01 | | CQVYDNSVDHAVF |
| 18-1B03H | IGHV3-23*01 | IGHJ5*02 | IGHD4-17*01 | CAKEPYRDYLGNWPDPW |
| 18-1B03L | IGKV4-1*01 | IGKJ3*01 | | CHQHYTIPPTF |
| 18-1C01H | IGHV1-69*01 | IGHJ5*02 | IGHD5-24*01 | CARRQVATYWFDPW |
| 18-1C01L | IGLV3-21*02 | IGLJ1*01 | | CQVWDSNSGHFVF |
| 18-1D04H | IGHV3-23*01 | IGHJ4*02 | IGHD6-19*01 | CATSPATSGWWWAYW |
| 18-1D04L | IGKV3-20*01 | IGKJ2*01 | | CHQYDIPPQTF |
| 18-2B05H | IGHV3-23*01 | IGHJ4*02 | IGHD6-13*01 | CARPTPYGTTWFGRVDSW |
| 18-2B05L | IGKV1-39*01 or IGKV1D-39*01 | IGKJ3*01 | | CQQTYRTPITF |
| 18-2E03H | IGHV3-74*01 or IGHV3-74*03 | IGHJ4*02 | IGHD5-12*01 | CARGDLVSTANFDYW |
| 18-2E03L | IGKV3-20*01 | IGKJ2*01 | | CQQYENSQHGSSPPYTF |
| 19-1B04H | IGHV3-74*01 | IGHJ3*02 | IGHD4-17*01 | CARDHDYGDYRGNAFDMW |
| 19-1B04L | IGKV1-33*01 or IGKV1D-33*01 | IGKJ4*01 | | CQQLHTF |
| 19-4A01H | IGHV4-39*01 | IGHJ3*01 | IGHD3-10*01 | CARLFGELVGYQAFDVW |
| 19-4A01L | IGLV1-44*01 | IGLJ1*01 | | CAAWDDSLNGYVF |
| 19-4C01H | IGHV4-31*03 | IGHJ6*02 | IGHD2-21*02 | CARELGDYPYYYAMDVW |
| 19-4C01L | IGKV1-9*01 | IGKJ1*01 | | CQQVITFPRTF |
| 19-4C02H | IGHV4-39*02 | IGHJ6*02 | IGHD3-10*01 | CARRWFGELDYYGSDVW |
| 19-4C02L | IGLV4-69*01 | IGLJ2*01 or IGLJ3*01 | | CQTWGTDXQVF |
| 19-4C05H | IGHV4-59*01 | IGHJ6*03 | IGHD5-18*01 | CARGVSALVSVDYYYYYMDVW |
| 19-4C05L | IGLV3-21*01 | IGLJ1*01 | | CQVWDRNIDPHF |
| 19-4D02H | IGHV4-59*01 | IGHJ6*03 | IGHD5-18*01 | CARGVSALVSVDYYYYYMDVW |
| 19-4D02L | IGLV3-21*01 | IGLJ1*01 | | CQVWDRNIDPHF |
| 19-4E01H | IGHV4-59*01 or IGHV4-59*03 | IGHJ6*02 | IGHD4-17*01 | VYYCVRADGDSEGFGYHYGMDVW |
| 19-4E01L | IGKV1-17*01 | IGKJ1*01 | | CLQHNDYPLTF |
| 19-4E03H | IGHV1-69*01 | IGHJ3*02 | IGHD4-11*01 | CARAARLYQQAYDIW |
| 19-4E03L | IGKV1-13*02 | IGKJ3*01 | | CQQFHSYPLFTF |
| 19-4F03H | IGHV4-39*01 | IGHJ3*01 or IGHJ3*02 | IGHD3-10*02 | CARLFGELVGYQAFDFW |
| 19-4F03L | IGLV1-44*01 | IGLJ1*01 | | CAAWDDSLDGYVF |
| 19-4G01H | IGHV3-30*03 or IGHV3-30*18 | IGHJ6*02 | IGHD6-13*01 | CAKIFSWQQLDYYYYAMDVW |
| 19-4G01L | IGLV1-44*01 | IGLJ2*01 or IGLJ3*01 | | CAAWDDSLDGVVF |
| 20-3B04H | IGHV3-23*01 | IGHJ4*02 | IGHD7-27*01 | CAKDHRGW |
| 20-3B04L | IGKV1-33*01 or IGKV1D-33*01 | IGKJ1*01 | | CQQFDKFPWTF |
| 20-3B06H | IGHV4-39*01 | IGHJ4*02 | IGHD3-16*01 | CARHAKAPDSFGGAEYFDYW |
| 20-3B06L | IGKV3-15*01 | IGKJ2*01 | | CQQYNEWPPMYTF |

ANTIBODIES DIRECTED AGAINST INFLUENZA

CROSS REFERENCE TO RELATED APPLICATION

This claims the benefit of U.S. Provisional Application No. 61/548,704, filed Oct. 18, 2011 and U.S. Provisional Application No. 61/603,895, filed Feb. 27, 2012. Both of the prior provisional applications are incorporated herein by reference in their entirety.

ACKNOWLEDGMENT OF GOVERNMENT SUPPORT

This invention was made with government support under AI057266, HHSN266200700006C and RR025008 awarded by The National Institutes of Health. The government has certain rights in the invention.

FIELD

This relates the field of influenza viruses, specifically to monoclonal antibodies, and antigen binding fragments thereof, that specifically bind an influenza virus protein.

PARTIES TO JOINT RESEARCH AGREEMENT

There is a joint research agreement between Emory University and The University of Chicago.

SEQUENCE LISTING

The instant application contains a Sequence Listing which has been submitted in ASCII format via EFS-Web and is hereby incorporated by reference in its entirety. Said ASCII copy, created on Oct. 18, 2012 is named 69758888.txt and is 611,150 bytes in size.

BACKGROUND

Influenza is the seventh leading cause of death in the United States (Beigel J H (2008), *Crit Care Med* 36(9):2660-2666). The elderly, the very young, pregnant women and otherwise immune-compromised populations account for over 90% of influenza-related deaths. The pandemic H1N1 influenza virus strain is immunologically distinct from other influenza viruses, leaving large population groups susceptible to infection (Brockwell-Staats et al., *Influenza Other Respi Viruses* 3:207-21, 2009; Dawood et al., *N Engl J Med* 360: 2605-2615, 2009; Garten et al., *Science* 325:197-201, 2009; Hancock K, et al. (2009) *N Engl J Med* 361(20):1945-1952). The Center for Disease Control (CDC) reports that the 2009 H1N1 pandemic strain caused an estimated 60 million cases and 256,000 hospitalizations. An unusually high frequency of severe disease occurred in younger and otherwise healthy patients (Hancock et al., 2009, supra). In addition, rare infections with avian H5N1 influenza strains in humans had close to a 50% mortality rate (Subbarao and Joseph, 2007, *Nat Rev Immunol* 7:267-278). Emergence of a zoonotic or antigenically distinct strain that combined even a fraction of the morbidity and mortality of the pandemic H1N1 and H5N1 viruses would have dire consequences.

Antibodies play a key role in protection against influenza infection in vivo (Gerhard et al., 1997; *Immunological reviews* 159:95-103; Luke et al., 2006, *Annals of internal medicine* 145:599-609; Puck et al., 1980, *Journal of infectious diseases* 142:844-849; Simmons et al., 2007, *PloS Medicine* 4:e178). The fact that there was little or no pre-existing antibody titers present prior to the emergence of this pandemic virus, and that the virus atypically caused such severe disease in young adults illustrates the importance of comprehensively understanding the B cell responses and antibody specificities induced by infection with this influenza virus. A need remains for reagents to treat and diagnose an influenza virus infection in a subject.

SUMMARY

Antibodies that specifically bind influenza virus hemagglutin A (HA), and antigen binding fragments thereof are disclosed herein. In some embodiments, these antibodies are broadly cross reactive. In additional embodiments, the antibodies inhibit hemmagglutination activity and neutralize more than one of H1N1, H5N1 and H3N2. In some embodiments, the antibody specifically binds H1N1 and H5N1. In other embodiments, the antibody specifically binds H1N1 and H3N2. In yet other embodiments, the antibody specifically binds H1N1, H5N1 and H3N2. In further embodiments, the antibody specifically binds HA of one or more of Pandemic (H1N1) 2009; A/Brevig mission/1/18(H1N1) 1918; and A/Brisbane/59/07(H1N1) 2007A/Indonesia/5/05 (H5N1) 2005; A/Brisbane10/07 (H3N2) 2007. The antibody can bind the HA globular head and or the HA stalk. In some embodiments, the antibody specifically binds a complex of HA1 and HA2.

In several embodiments, nucleic acids encoding these monoclonal antibodies, vectors including these nucleic acids, and host cells transformed with these vectors are also disclosed. Compositions are disclosed that include these antibodies, antigen binding fragments, nucleic acids, vectors and host cells.

Methods of using these antibodies, and antigen binding fragments, nucleic acids, vectors and host cells, such as for diagnosis and treatment of an influenza virus infection are also provided. In some embodiments, these antibodies and antigen binding fragments are used to diagnose an influenza virus infection is provided. In other embodiments, these antibodies, antigen binding fragments, nucleic acids, vectors, or host cells are used for the treatment and or prevention of an influenza virus.

The foregoing and other objects, features, and advantages of the invention will become more apparent from the following detailed description, which proceeds with reference to the accompanying figures.

BRIEF DESCRIPTION OF THE DRAWINGS

FIGS. 1A-1D. Rapid and potent plasmablast and serological responses after vaccination with the monovalent pandemic H1N1 2009 vaccine. Healthy adult volunteers were vaccinated with the pandemic H1N1 2009 monovalent vaccine. A control group was vaccinated with the 2008/09 TIV in 2008. (A) Fold change in serum antibody titers between day 0 and day 28 were determined by HAI. (B) The number of vaccine-specific IgG-producing plasmablasts were determined by ELISPOT at 0, 7, 14 and 28 days post-vaccination. (C) The number of vaccine-specific plasmablasts correlates with improved serum antibody titers by HAI (Spearman's rank correlation). (D) The numbers of vaccine-specific IgG-, IgA-, and IgM-producing plasmablasts at day 7 after vaccination as determined by ELISPOT. Dotted lines=limit of detection.

FIGS. 2A-2D. Stem-binding antibodies are induced following pandemic H1N1 2009 vaccination. Human mAbs were generated from plasmablasts isolated from individuals vaccinated with the pandemic H1N1 2009 vaccine. (A) Binding to the pandemic H1N1 2009 virus by ELISA. (B) Binding to pandemic H1N1 2009 HA by ELISA. (C) All HA-binding mAbs were tested for HAI and neutralization activity. Three putative stem-binding mAbs are highlighted in blue. Dotted lines represent the highest concentration of mAb tested. Data are representative of 2-4 repeat experiments. (D) The 3 putative stem-binding mAbs were tested by competition ELISA with 2 known stem-binding mAbs (70-1F02 and 70-5B03) (8). Percentage inhibition is the ratio of binding with or without competitor. The reciprocal stem-binding mAb for each assay in the pair was used as a positive control and EM4C04 which binds the HA head was used as a negative control. Bars represent means+/−SEM for three repeats. The $V_H$ gene usage of the individual stem-binding mAbs is indicated on the right.

FIGS. 4A-4B. Monoclonal antibodies induced following the pandemic H1N1 2009 vaccine display high levels of somatic hypermutation consistent with a recall response. Variable genes from plasmablasts induced following the pandemic H1N1 2009 vaccine were amplified by single-cell RT-PCR and scored for numbers of somatic mutations. (A) The number of mutations per $V_H$ gene following pandemic H1N1 2009 vaccination are compared with previously published data (12, 27-29). The red line shows the mean (p-values are from Student's t-tests). (B) The number of mutations per $V_H$ gene in HA-specific mAbs only. Colors represent the degree of cross-reactivity as in FIG. 3.

FIGS. 10A-10C. Patterns of crossreactivity among HA specific vaccine-induced monoclonal antibodies. The 28 HA specific monoclonal antibodies were analyzed by ELISA for their binding to HA proteins derived from either the pandemic H1N1 2009 or the Brisbane H1N1 (A/Brisbane/59/07 (H1N1)) influenza strains. The antibodies showed binding patterns that conformed to three distinct categories. One category (9/28 antibodies) showed very similar binding to both HAs (A). Another category (14/28) showed better binding to the pandemic H1N1 HA, likely representing ongoing adaptation through affinity maturation (B), while the last category (5/28) bound better to the Brisbane HA (C), consistent with OAS (original antigenic sin).

FIG. 12 (Table 1). Amino acid sequence information for H1N1 binding antibodies. Table 1 provides detailed information, including sequence information, about each of the antibodies that were confirmed to bind influenza. Each antibody is identified in Col. A by antibody name and an indication of whether the heavy or light chain is being described. Heavy chains are indicated by H and light chains are indicated by L at the end of the identifier in Col. A. For example, line 2 of Table 1 discloses 005-2G02H, which is a heavy chain for one of the cloned antibodies, and line 3 of Table 1 discloses 005-2G02L, which is the light chain for the same antibody. Accordingly, each pair of rows (2/3, 4/5, 6/7, 8/9, 10/11, 12/13, 14/15, 16/17, 18/19, 20/21, 22/23, 24/25, 26/27, 28/29, 30/31, 32/33, 34/35, 36/37, 38/39, 40/41, 42/43, 44/45, 46/47, 48/49, 50/51, 52/53, 54/55, 56/57, 58/59, 60/61, 62/63, 64/65, 66/67, 68/69, 70/71, 72/73, 74/75, 76/77, 78/79, 80/81, 82/83, 84/85, 86/87, 88/89, 90/91, 92/93, 94/95, 96/97, 98/99, 100/101, 102/103, 104/105, 106/107, 108/109, 110/111, 112/113, 114/115, 116/117, 118/119, 120/121, 122/123, 124/125, 126/127, 128/129, 130/131, 132/133, 134/135, 136/137, 138/139, and 140/141) represent paired heavy and light chains from a cloned human antibody. Col. G provides the V region amino acid sequence. Col. H provides the FR1 amino acid sequence. Col. I provides the CDR1 amino acid sequence. Col. J provides the FR2 amino acid sequence. Col. K provides the CDR2 amino acid sequence. Col. L provides the FR3 amino acid sequence. Col. M provides the CDR3 amino acid sequence. Col. N provides the nucleotide sequence. Col. O provides the translated V region amino acid sequence. Column P provides the FR4 amino acid sequence.

FIG. 13. Clinical characteristics of study and control groups (Table 2). Number of subjects, age, gender and time interval between receiving pandemic (H1N1) 2009 vaccine and 2009/10 TIV are shown. Age and interval between vaccinations are expressed as median and range.

FIGS. 14A and 14B. Sequence, mutation and V-gene rearrangement data for pandemic (H1N1) 2009 virus-specific mAbs (Table 3). Variable genes were amplified from plasmablasts stimulated by pandemic (H1N1) 2009 vaccine by single-cell RT-PCR and then determined using in-house analysis software compared with the Immunogentics V gene dataset and the IMGT search engine. FIG. 14A discloses SEQ ID NOS 1401-1478, residues 2-28 of SEQ ID NO: 1479 and SEQ ID NOS 1480-1498, respectively, in order of appearance, and FIG. 14B discloses SEQ ID NOS 1499-1540, respectively, in order of appearance.

DETAILED DESCRIPTION

Figure 3A:
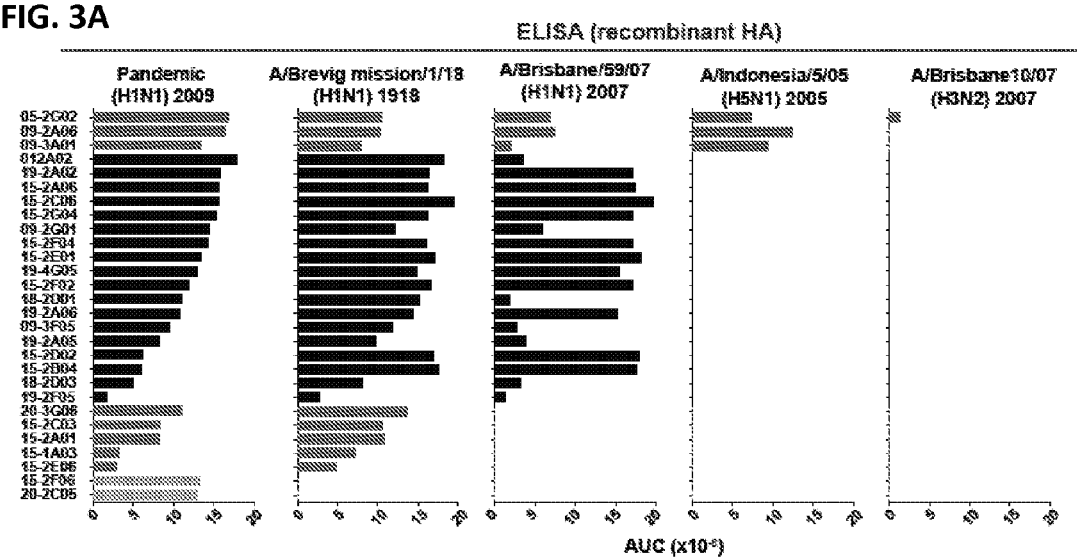
FIGS. 3A-3C. The pandemic H1N1 2009 vaccine induces highly cross-reactive HA-specific antibodies. (A) Twenty-eight pandemic H1N1 HA-binding mAbs were tested for binding to HAs from the indicated influenza strains by ELISA. (B) Twenty-five HA head-binding mAbs were tested for neutralizing activity against the indicated panel of H1N1 virus strains. Two mAbs (20-3G06 and 15-1A03) expressed poorly and were not tested for cross-reactivity (ND). (C) Three stem-binding mAbs were tested for neutralizing activity against various influenza virus strains. Influenza strains are arranged from left to right in order of sequence similarity to the pandemic H1N1 2009. Monoclonal antibodies are arranged according to degree of binding by ELISA to pandemic H1N1 2009 HA and grouped according to cross-reactivity by ELISA (blue: stem-binders, bind all H1N1, H5N1 and H3N2; black: bind all H1N1; red: bind A/California/04/09 and A/Brevig Mission/1/18; green: bind A/California/04/09 only). Dotted lines represent limits of detection. Data are representative of 2-4 repeats.

Influenza viruses are segmented negative-strand RNA viruses that belong to the Orthomyxoviridae family. There are three types of Influenza viruses, A, B and C. Influenza A viruses infect a wide variety of birds and mammals, including humans, horses, marine mammals, pigs, ferrets, and chickens. In animals, most influenza A viruses cause localized infections of the respiratory and intestinal tract. Animals infected with influenza A often act as a reservoir for the influenza viruses and certain subtypes have been shown to cross the species barrier to humans.

The influenza A virus genome encodes nine structural proteins and one nonstructural (NS1) protein with regulatory functions. The influenza virus segmented genome contains eight negative-sense RNA (nsRNA) gene segments (PB2, PB1, PA, NP, M, NS, HA and NA) that encode at least ten polypeptides, including RNA-directed RNA polymerase proteins (PB2, PB1 and PA), nucleoprotein (NP), neuraminidase (NA), hemagglutinin (subunits HA1 and HA2), the matrix proteins (M1 and M2) and the non-structural proteins (NS1 and NS2) (Krug et al., In "The Influenza Viruses," R. M. Krug, ed., Plenum Press, N.Y., 1989, pp. 89 152).

HA is a viral surface glycoprotein generally comprising approximately 560 amino acids and representing 25% of the total virus protein. It is responsible for adhesion of the viral particle to, and its penetration into, a host cell in the early stages of infection. Cleavage of the virus HA0 precursor into the HA1 and HA2 sub-fragments is a necessary step in order for the virus to infect a cell. Thus, cleavage is required in order to convert new virus particles in a host cell into virions capable of infecting new cells. Cleavage is known to occur during transport of the integral HA0 membrane protein from the endoplasmic reticulum of the infected cell to the plasma membrane. In the course of transport, hemagglutinin undergoes a series of co- and post-translational modifications including proteolytic cleavage of the precursor HA into the amino-terminal fragment HA1 and the carboxy terminal HA2.

Antibodies, including human and/or humanized forms, as well as fragment, derivatives/conjugates and compositions thereof that bind to an HA domain of influenza A are provided herein. Methods of using these antibodies are also provided.

In several embodiments, these antibodies are broadly cross reactive. In additional embodiments, the antibodies inhibit hemmagglutination activity and neutralize more than one of H1N1, H5N1 and H3N2. In some embodiments, the antibody specifically binds H1N1 and H3N2. In further embodiments, the antibody specifically binds HA of one or more of Pandemic (H1N1) 2009; A/Brevig mission/1/18 (H1N1) 1918; and A/Brisbane/59/07(H1N1) 2007A/Indonesia/5/05 (H5N1) 2005; A/Brisbane10/07 (H3N2) 2007. The antibody can bind the HA globular head and or the HA stalk. In some embodiments the antibodies are broadly cross-reactive and provide heterosubtypic protection.

Terms

Unless otherwise noted, technical terms are used according to conventional usage. Definitions of common terms in molecular biology can be found in Benjamin Lewin, Genes V, published by Oxford University Press, 1994 (ISBN 0-19-854287-9); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8). Terms describing protein structure and structural elements of proteins can be found in Creighton, Proteins, Structures and Molecular Properties, W.H. Freeman & Co., New York, 1993 (ISBN 0-717-7030) which is incorporated by reference herein in its entirety.

Unless otherwise explained, all technical and scientific terms used herein have the same meaning as commonly understood by one of ordinary skill in the art to which this disclosure belongs. The singular terms "a," "an," and "the" include plural referents unless context clearly indicates otherwise. Similarly, the word "or" is intended to include A, B or both unless the context clearly indicates otherwise.

It is further to be understood that all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described below. In case of conflict, the present specification, including explanations of terms, will control. In addition, the materials, methods, and examples are illustrative only and not intended to be limiting.

To facilitate review of the various embodiments of this disclosure, the following explanations of terms are provided:

Administration: The introduction of a composition into a subject by a chosen route. Administration can be local or systemic. For example, if the chosen route is intravenous, the composition is administered by introducing the composition into a vein of the subject. In some examples a disclosed antibody that specifically binds HA, or a nucleic acid encoding the antibody, is administered to a subject.

Amino acid substitution: The replacement of one amino acid in peptide with a different amino acid.

Amplification: A technique that increases the number of copies of a nucleic acid molecule (such as an RNA or DNA). An example of amplification is the polymerase chain reaction, in which a biological sample is contacted with a pair of oligonucleotide primers, under conditions that allow for the hybridization of the primers to a nucleic acid template in the sample. The primers are extended under suitable conditions, dissociated from the template, and then re-annealed, extended, and dissociated to amplify the number of copies of the nucleic acid. The product of amplification can be characterized by electrophoresis, restriction endonuclease cleavage patterns, oligonucleotide hybridization or ligation, and/or nucleic acid sequencing using standard techniques. Other examples of amplification include strand displacement amplification, as disclosed in U.S. Pat. No. 5,744,311; transcription-free isothermal amplification, as disclosed in U.S. Pat. No. 6,033,881; repair chain reaction amplification, as disclosed in PCT Publication No. WO 90/01069; ligase chain reaction amplification, as disclosed in EP-A-320 308; gap filling ligase chain reaction amplification, as disclosed in U.S. Pat. No. 5,427,930; and NASBA™ RNA transcription-free amplification, as disclosed in U.S. Pat. No. 6,025,134.

Animal: Living multi-cellular vertebrate organisms, a category that includes, for example, mammals and birds. The term mammal includes both human and non-human mammals. Similarly, the term "subject" includes both human and veterinary subjects.

Antibody: A polypeptide substantially encoded by an immunoglobulin gene or immunoglobulin genes, or antigen binding fragments thereof, which specifically binds and recognizes an analyte (antigen) such as HA or an antigenic fragment of HA, such as a conserved domain from the stalk or head of the HA protein. Immunoglobulin genes include the kappa, lambda, alpha, gamma, delta, epsilon and mu constant region genes, as well as the myriad immunoglobulin variable region genes. encompass monoclonal antibodies (including full-length monoclonal antibodies), polyclonal antibodies, multispecific antibodies formed from at least two different epitope binding fragments (e.g., bispecific antibodies), human antibodies, humanized antibodies, camelised antibodies, chimeric antibodies, single-chain Fvs (scFv), single-chain antibodies, single domain antibodies, domain antibodies, Fab fragments, F(ab')$_2$ fragments, antibody fragments that exhibit the desired biological activity (e.g. the antigen binding portion), disulfide-linked Fvs (dsFv), and anti-idiotypic (anti-Id) antibodies (including, e.g., anti-Id antibodies to antibodies of the invention), intrabodies, and epitope-binding fragments of any of the above. In particular, antibodies include immunoglobulin molecules and immunologically active fragments of immunoglobulin molecules, i.e., molecules that contain at least one antigen-binding site. Immunoglobulin molecules can be of any isotype, for example, IgG, IgE, IgM, IgD, IgA and IgY), subisotype (e.g., IgG$_1$, IgG$_2$, IgG$_3$, IgG$_4$, IgA1 and IgA2) or allotype (e.g., Gm, e.g., G1m(f, z, a or x), G2m(n), G3m(g, b, or c), Am, Em, and Km(1, 2 or 3). Antibodies can be derived from any mammal, including, but not limited to, humans, monkeys, pigs, horses, rabbits, dogs, cats, mice, etc., or other animals such as birds (e.g. chickens).

Native antibodies are usually heterotetrameric glycoproteins of about 150,000 daltons, composed of two identical light (L) chains and two identical heavy (H) chains. Each light chain is linked to a heavy chain by one covalent disulfide bond, while the number of disulfide linkages varies between the heavy chains of different immunoglobulin isotypes. Each heavy and light chain also has regularly spaced intrachain disulfide bridges. Each heavy chain has at one end a variable domain ($V_H$) followed by a number of constant domains ($C_H$). Each light chain has a variable domain at one end ($V_L$) and a constant domain ($C_L$) at its other end; the constant domain of the light chain is aligned with the first constant domain of the heavy chain, and the light chain variable domain is aligned with the variable domain of the heavy chain. References to "$V_H$" or "VH" refer to the variable region of an immunoglobulin heavy chain, including that of an antibody fragment, such as Fv, scFv, dsFv or Fab. References to "$V_L$" or "VL" refer to the variable region of an immunoglobulin light chain, including that of an Fv, scFv, dsFv or Fab. Light chains are classified as either lambda chains or kappa chains based on the amino acid sequence of the light chain constant region. The variable domain of a kappa light chain may also be denoted herein as $V_K$.

Light and heavy chain variable domains contain a "framework" region interrupted by three hypervariable regions, also called "complementarity-determining regions" or "CDRs." The CDRs are primarily responsible for binding to an epitope of an antigen. The precise amino acid sequence boundaries of a given CDR can be readily determined using any of a number of well-known schemes, including those described by Kabat et al. ("Sequences of Proteins of Immunological Interest," 5th Ed. Public Health Service, National Institutes of Health, Bethesda, Md., 1991; "Kabat" numbering scheme), Al-Lazikani et al., (JMB 273,927-948, 1997; "Chothia" numbering scheme), and Lefranc, et al. ("IMGT unique numbering for immunoglobulin and T cell receptor variable domains and Ig superfamily V-like domains," Dev. Comp. Immunol., 27:55-77, 2003; "IMGT" numbering scheme). The CDRs of each chain are typically referred to as CDR1, CDR2, and CDR3, numbered sequentially starting from the N-terminus, and are also typically identified by the chain in which the particular CDR is located. Thus, a $V_H$ CDR3 is located in the variable domain of the heavy chain of the antibody in which it is found, whereas a $V_L$ CDR1 is the CDR1 from the variable domain of the light chain of the antibody in which it is found. Light chain CDRs are sometimes referred to as CDR L1, CDR L2, and CDR L3. Heavy chain CDRs are sometimes referred to as CDR H1, CDR H2, and CDR H3. The location of the framework region and CDRs readily can be identified (see, Kabat et al., *Sequences of Proteins of Immunological Interest*, U.S. Department of Health and Human Services, 1991, which is hereby incorporated by reference in its entirety). Thus one of ordinary skill in the art will recognize the numbering of the residues in the disclosed antibodies when made with reference to the Kabat convention; the Kabat database is now maintained online. The sequences of the framework regions of different light or heavy chains are relatively conserved within a species. The framework region of an antibody, that is the combined framework regions of the constituent light and heavy chains, serves to position and align the CDRs in three-dimensional space.

A "monoclonal antibody" is an antibody produced by a single clone of B-lymphocytes or by a cell into which the light and heavy chain genes of a single antibody have been transfected. Monoclonal antibodies are produced by methods known to those of skill in the art, for instance by making hybrid antibody-forming cells from a fusion of myeloma cells with immune spleen cells. These fused cells and their progeny are termed "hybridomas." Monoclonal antibodies include humanized and fully human monoclonal antibodies. In some examples monoclonal antibodies are isolated from a subject. The amino acid sequences of such isolated monoclonal antibodies can be determined.

A "humanized" immunoglobulin is an immunoglobulin including a human framework region and one or more CDRs from a non-human (such as a mouse, rat, or synthetic) immunoglobulin. The non-human immunoglobulin providing the CDRs is termed a "donor," and the human immunoglobulin providing the framework is termed an "acceptor." In one embodiment, all the CDRs are from the donor immunoglobulin in a humanized immunoglobulin. Constant regions need not be present, but if they are, they must be substantially identical to human immunoglobulin constant regions, such as at least about 85-90%, such as about 95% or more identical. Hence, all parts of a humanized immunoglobulin, except possibly the CDRs, are substantially identical to corresponding parts of natural human immunoglobulin sequences. A "humanized antibody" is an antibody comprising a humanized light chain and a humanized heavy chain immunoglobulin. A humanized antibody binds to the same antigen as the donor antibody that provides the CDRs. The acceptor framework of a humanized immunoglobulin or antibody may have a limited number of substitutions by amino acids taken from the donor framework. Humanized or other monoclonal antibodies can have additional conservative amino acid substitutions, such as in the framework region, which have substantially no effect on antigen binding or other immunoglobulin functions. Humanized immunoglobulins can be constructed by means of genetic engineering (for example, see U.S. Pat. No. 5,585,089).

Antigen: A compound, composition, or substance that can stimulate the production of antibodies or a T cell response in an animal, including compositions that are injected or absorbed into an animal. An antigen reacts with the products of specific humoral and/or cellular immunity, including those induced by heterologous antigens, such as the disclosed antigens. "Epitope" or "antigenic determinant" refers to the region of an antigen to which B and/or T cells respond. In one embodiment, T cells respond to the epitope, when the epitope is presented in conjunction with an MHC molecule. Epitopes can be formed both from contiguous amino acids or noncontiguous amino acids juxtaposed by tertiary folding of a protein. Epitopes formed from contiguous amino acids are typically retained on exposure to denaturing solvents whereas epitopes formed by tertiary folding are typically lost on treatment with denaturing solvents. An epitope typically includes at least 3, and more usually, at least 5, about 9, or about 8-10 amino acids in a unique spatial conformation. Methods of determining spatial conformation of epitopes include, for example, x-ray crystallography and nuclear magnetic resonance.

Examples of antigens include, but are not limited to, peptides, lipids, polysaccharides, and nucleic acids containing antigenic determinants, such as those recognized by an immune cell. In some examples, antigens include peptides derived from a pathogen of interest. Exemplary pathogens include bacteria, fungi, viruses and parasites. In specific examples, an antigen is derived from influenza, such as HA or antigenic fragment thereof, such as the HA stalk or globular domain.

A "target epitope" is a specific epitope on an antigen that specifically binds an antibody of interest, such as a monoclonal antibody. In some examples, a target epitope includes the amino acid residues that contact the antibody of interest, such that the target epitope can be selected by the amino acid residues determined to be in contact with the antibody of interest.

Binding affinity: Affinity of an antibody or antigen binding fragment thereof for an antigen. An antibody specifically binds its target epitope. In one embodiment, affinity is calculated by a modification of the Scatchard method described by Frankel et al., *Mol. Immunol.*, 16:101-106, 1979. In another embodiment, binding affinity is measured by an antigen/antibody dissociation rate. In yet another embodiment, a high binding affinity is measured by a competition radioimmunoassay. In several examples, a high binding affinity is at least about $1 \times 10^{-8}$ M. In other embodiments, a high binding affinity is at least about $1.5 \times 10^{-8}$, at least about $2.0 \times 10^{-8}$, at least about $2.5 \times 10^{-8}$, at least about $3.0 \times 10^{-8}$, at least about $3.5 \times 10^{-8}$, at least about $4.0 \times 10^{-8}$, at least about $4.5 \times 10^{-8}$, or at least about $5.0 \times 10^{-8}$ M.

Chimeric antibody: An antibody which includes sequences derived from two different antibodies, which typically are of different species. In some examples, a chimeric antibody includes one or more CDRs and/or framework regions from one human antibody and CDRs and/or framework regions from another human antibody. In other examples, a chimeric antibody includes one or more CDRs and/or framework regions from one human antibody and CDRs and/or framework regions from a chimpanzee antibody.

Contacting: Placement in direct physical association; includes both in solid and liquid form, which can take place either in vivo or in vitro. Contacting includes contact between one molecule and another molecule, for example the amino acid on the surface of one polypeptide, such as an antigen, that contacts another polypeptide, such as an antibody. Contacting can also include contacting a cell for example by placing an antibody in direct physical association with a cell.

Epitope: A protein determinant that is specifically bound by an antibody. Epitopes usually consist of chemically active surface groupings of molecules such as amino acids or sugar side chains and usually have specific three dimensional structural characteristics, as well as specific charge characteristics. Conformational and non-conformational epitopes are distinguished in that the binding to the former but not the latter is lost in the presence of denaturing solvents.

Framework Region: Amino acid sequences interposed between CDRs. Includes variable light and variable heavy framework regions. The framework regions serve to hold the CDRs in an appropriate orientation for antigen binding.

Fc polypeptide: The polypeptide comprising the constant region of an antibody excluding the first constant region immunoglobulin domain. Fc region generally refers to the last two constant region immunoglobulin domains of IgA, IgD, and IgG, and the last three constant region immunoglobulin domains of IgE and IgM. An Fc region may also include part or all of the flexible hinge N-terminal to these domains. For IgA and IgM, an Fc region may or may not comprise the tailpiece, and may or may not be bound by the J chain. For IgG, the Fc region comprises immunoglobulin domains Cgamma2 and Cgamma3 (Cγ2 and Cγ3) and the lower part of the hinge between Cgamma1 (Cγ1) and Cγ2. Although the boundaries of the Fc region may vary, the human IgG heavy chain Fc region is usually defined to comprise residues C226 or P230 to its carboxyl-terminus, wherein the numbering is according to the EU index as in Kabat. For IgA, the Fc region comprises immunoglobulin domains Calpha2 and Calpha3 (Cα2 and Cα3) and the lower part of the hinge between Calpha1 (Cα1) and Cα2. Encompassed within the definition of the Fc region are functionally equivalent analogs and variants of the Fc region. A functionally equivalent analog of the Fc region may be a variant Fc region, comprising one or more amino acid modifications relative to the wild-type or naturally existing Fc region. Variant Fc regions will possess at least 50% homology with a naturally existing Fc region, such as about 80%, and about 90%, or at least about 95% homology. Functionally equivalent analogs of the Fc region may comprise one or more amino acid residues added to or deleted from the N- or C-termini of the protein, such as no more than 30 or no more than 10 additions and/or deletions. Functionally equivalent analogs of the Fc region include Fc regions operably linked to a fusion partner. Functionally equivalent analogs of the Fc region must comprise the majority of all of the Ig domains that compose Fc region as defined above; for example IgG and IgA Fc regions as defined herein must comprise the majority of the sequence encoding $CH_2$ and the majority of the sequence encoding $CH_3$. Thus, the $CH_2$ domain on its own, or the $CH_3$ domain on its own, are not considered Fc region. The Fc region may refer to this region in isolation, or this region in the context of an Fc fusion polypeptide (such as an immunoadhesin)

Hemagglutinin (HA): An influenza virus surface glycoprotein that is a homotrimeric integral membrane glycoprotein. HA mediates binding of the virus particle to a host cells and subsequent entry of the virus into the host cell. The nucleotide and amino acid sequences of numerous influenza HA proteins are known in the art and are publically available, such as through the NCBI Influenza Virus Resource database (Bao et al., *J Virol* 82:596-601, 2008). HA (along with NA) is one of the two major influenza virus antigenic determinants. The crystal structure of hemagglutinin is deposited as PDB code 5 hmg. The three identical monomers that constitute HA are constructed into a central a helix coil; three spherical heads contain the sialic acid binding sites. In nature, HA monomers are synthesized as precursors that are then glycosylated and cleaved into two smaller polypeptides: the HA1 and HA2 subunits. Each HA monomer consists of a long, helical chain anchored in the membrane by HA2 and topped by a large HA1 globular head which contains the sialic acid receptor binding sites. The HA2 protein chain facilitates membrane fusion; the C-terminal end of the protein is embedded in the viral membrane. The stalk of HA is comprised of portions of HA1 and HA2.

Host cells: Cells in which a vector can be propagated and its DNA expressed, for example a disclosed antibody can be expressed in a host cell. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Immunoadhesin: A molecular fusion of a protein with the Fc region of an immunoglobulin, wherein the immunoglobulin retains specific properties, such as Fc receptor binding and increased half-life. An Fc fusion combines the Fc region of an immunoglobulin with a fusion partner, which in general can be any protein, polypeptide, peptide, or small molecule. In one example, and immunoadhesin includes the hinge, $CH_2$, and $CH_3$ domains of the immunoglobulin gamma 1 heavy chain constant region. In another example, the immunoadhesin includes the $CH_2$, and $CH_3$ domains of an IgG.

Immunologically reactive conditions: Includes reference to conditions which allow an antibody raised against a particular epitope to specifically bind to that epitope to a detectably greater degree than, and/or to the substantial exclusion of, binding to substantially all other epitopes. Immunologically reactive conditions are dependent upon the format of the antibody binding reaction and typically are those utilized in immunoassay protocols or those conditions encountered in vivo. See Harlow & Lane, supra, for a description of immunoassay formats and conditions. The immunologically reactive conditions employed in the methods are "physiological conditions" which include reference to conditions (e.g., temperature, osmolarity, pH) that are typical inside a living mammal or a mammalian cell. While it is recognized that some organs are subject to extreme conditions, the intra-organismal and intracellular environment normally lies around pH 7 (e.g., from pH 6.0 to pH 8.0, more typically pH 6.5 to 7.5), contains water as the predominant solvent, and exists at a temperature above 0° C. and below 50° C. Osmolarity is within the range that is supportive of cell viability and proliferation.

IgA: A polypeptide belonging to the class of antibodies that are substantially encoded by a recognized immunoglobulin alpha gene. In humans, this class or isotype comprises $IgA_1$ and $IgA_2$. IgA antibodies can exist as monomers, polymers (referred to as pIgA) of predominantly dimeric form, and secretory IgA. The constant chain of wild-type IgA contains an 18-amino-acid extension at its C-terminus called the tail piece (tp). Polymeric IgA is secreted by plasma cells with a 15-kDa peptide called the J chain linking two monomers of IgA through the conserved cysteine residue in the tail piece.

IgG: A polypeptide belonging to the class or isotype of antibodies that are substantially encoded by a recognized immunoglobulin gamma gene. In humans, this class comprises $IgG_1$, $IgG_2$, $IgG_3$, and $IgG_4$. In mice, this class comprises $IgG_1$, $IgG_{2a}$, $IgG_{2b}$, $IgG_3$.

Influenza virus: A segmented negative-strand RNA virus that belongs to the Orthomyxoviridae family. There are three types of influenza viruses, A, B and C. Influenza A viruses infect a wide variety of birds and mammals, including humans, horses, marine mammals, pigs, ferrets, and chickens. In animals, most influenza A viruses cause mild localized infections of the respiratory and intestinal tract. However, highly pathogenic influenza A strains, such as H5N1, cause systemic infections in poultry in which mortality may reach 100%. In 2009, H1N1 influenza was the most common cause of human influenza. A new strain of swine-origin H1N1 emerged in 2009 and was declared pandemic by the World Health Organization. This strain was referred to as "swine flu." H1N1 influenza A viruses were also responsible for the Spanish flu pandemic in 1918, the Fort Dix outbreak in 1976, and the Russian flu epidemic in 1977-1978. Influenza A viruses are categorized into subtypes based on the type of two proteins, hemagglutinin (H) and neuraminidase (N) that are on the surface of the viral envelope. Different influenza viruses encode for different hemagglutinin and neuraminidase proteins. Influenza A viruses include the following subtypes: H1N1 (Spanish flu or Swine flu), H2N2 (Asian flu), H3N2 (Hong Kong flu), H5N1 (bird flu), H7N7, H1N2, H9N2, H7N2, H7N3 and H10N7. An antibody that is "broadly neutralizing" or "broadly crossreactive," specifically binds to a polypeptide on more than one subtype and/or strain and inhibits viral entry and/or replication. For example, a broadly neutralizing antibody can specifically bind HA from at least two of H1N1 (Spanish flu or Swine flu), H2N2 (Asian flu), H3N2 (Hong Kong flu), H5N1 (bird flu), H7N7, H1N2, H9N2, H7N2, H7N3 and H10N7.

Inhibiting or treating a disease/infection: Inhibiting the full development of a disease or condition, for example, in a subject who is at risk for a disease such as an influenza infection. "Treatment" refers to a therapeutic intervention that ameliorates a sign or symptom of an infection or pathological condition (such as the flu) after it has begun to develop. The term "ameliorating," with reference to a disease/ infection or pathological condition, refers to any observable beneficial effect of the treatment. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters well known in the art that are specific to the particular disease. A "prophylactic" treatment is a treatment administered to a subject who does not exhibit signs of a disease/infection or exhibits only early signs for the purpose of decreasing the risk of developing pathology.

Isolated: An "isolated" biological component (such as a cell, for example a B cell, a nucleic acid, peptide, protein or antibody) has been substantially separated, produced apart from, or purified away from other biological components in the cell of the organism in which the component naturally occurs, such as, other chromosomal and extrachromosomal DNA and RNA, and proteins. Nucleic acids, peptides and proteins which have been "isolated" thus include nucleic acids and proteins purified by standard purification methods. The term also embraces nucleic acids, peptides, and proteins prepared by recombinant expression in a host cell as well as chemically synthesized nucleic acids. In some examples an antibody, such as an antibody specific for HA can be isolated, for example isolated from a subject infected with an influenza virus.

$K_d$: The dissociation constant for a given interaction, such as a polypeptide ligand interaction or an antibody antigen interaction. For example, for the bimolecular interaction of an antibody (such as 05-2G02, 09-2A06, and 09-3A01) and an antigen (such as HA) it is the concentration of the individual components of the bimolecular interaction divided by the concentration of the complex.

Label: A detectable compound or composition that is conjugated directly or indirectly to another molecule, such as an antibody or a protein, to facilitate detection of that molecule. Specific, non-limiting examples of labels include fluorescent tags, enzymatic linkages, and radioactive isotopes. In some examples, a disclosed antibody as labeled.

Neuraminidase (NA): An influenza virus membrane glycoprotein. NA is involved in the destruction of the cellular receptor for the viral HA by cleaving terminal sialic acid residues from carbohydrate moieties on the surfaces of infected cells. NA also cleaves sialic acid residues from viral proteins, preventing aggregation of viruses. NA (along with HA) is one of the two major influenza virus antigenic determinants.

Neutralizing antibody: An antibody which reduces the infectious titer of an infectious agent by binding to a specific antigen on the infectious agent. In some examples the infectious agent is a virus. In some examples, an antibody that is specific for HA reduces the infectious titer of influenza virus.

Nucleic acid: A polymer composed of nucleotide units (ribonucleotides, deoxyribonucleotides, related naturally occurring structural variants, and synthetic non-naturally occurring analogs thereof) linked via phosphodiester bonds, related naturally occurring structural variants, and synthetic non-naturally occurring analogs thereof. Thus, the term includes nucleotide polymers in which the nucleotides and the linkages between them include non-naturally occurring synthetic analogs, such as, for example and without limitation, phosphorothioates, phosphoramidates, methyl phosphonates, chiral-methyl phosphonates, 2-O-methyl ribonucleotides, peptide-nucleic acids (PNAs), and the like. Such polynucleotides can be synthesized, for example, using an automated DNA synthesizer. The term "oligonucleotide" typically refers to short polynucleotides, generally no greater than about 50 nucleotides. It will be understood that when a nucleotide sequence is represented by a DNA sequence (i.e., A, T, G, C), this also includes an RNA sequence (i.e., A, U, G, C) in which "U" replaces "T."

Conventional notation is used herein to describe nucleotide sequences: the left-hand end of a single-stranded nucleotide sequence is the 5'-end; the left-hand direction of a double-stranded nucleotide sequence is referred to as the 5'-direction. The direction of 5' to 3' addition of nucleotides to nascent RNA transcripts is referred to as the transcription direction. The DNA strand having the same sequence as an mRNA is referred to as the "coding strand;" sequences on the DNA strand having the same sequence as an mRNA transcribed from that DNA and which are located 5' to the 5'-end of the RNA transcript are referred to as "upstream sequences;" sequences on the DNA strand having the same sequence as the RNA and which are 3' to the 3' end of the coding RNA transcript are referred to as "downstream sequences."

"cDNA" refers to a DNA that is complementary or identical to an mRNA, in either single stranded or double stranded form.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA produced by that gene produces the protein in a cell or other biological system. Both the coding strand, the nucleotide sequence of which is identical to the mRNA sequence and is usually provided in sequence listings, and non-coding strand, used as the template for transcription, of a gene or cDNA can be referred to as encoding the protein or other product of that gene or cDNA. Unless otherwise specified, a "nucleotide sequence encoding an amino acid sequence" includes all nucleotide sequences that are degenerate versions of each other and that encode the same amino acid sequence. Nucleotide sequences that encode proteins and RNA may include introns.

"Recombinant nucleic acid" refers to a nucleic acid having nucleotide sequences that are not naturally joined together. This includes nucleic acid vectors comprising an amplified or assembled nucleic acid which can be used to transform a suitable host cell. A host cell that comprises the recombinant nucleic acid is referred to as a "recombinant host cell." The gene is then expressed in the recombinant host cell to produce, e.g., a "recombinant polypeptide." A recombinant nucleic acid may serve a non-coding function (e.g., promoter, origin of replication, ribosome-binding site, etc.) as well.

A first sequence is an "antisense" with respect to a second sequence if a polynucleotide whose sequence is the first sequence specifically hybridizes with a polynucleotide whose sequence is the second sequence.

Terms used to describe sequence relationships between two or more nucleotide sequences or amino acid sequences include "reference sequence," "selected from," "comparison window," "identical," "percentage of sequence identity," "substantially identical," "complementary," and "substantially complementary."

For sequence comparison of nucleic acid sequences, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters are used. Methods of alignment of sequences for comparison are well known in the art. Optimal alignment of sequences for comparison can be conducted, e.g., by the local homology algorithm of Smith & Waterman, *Adv. Appl. Math.* 2:482, 1981, by the homology alignment algorithm of Needleman & Wunsch, *J. Mol. Biol.* 48:443, 1970, by the search for similarity method of Pearson & Lipman, *Proc. Nat'l. Acad. Sci. USA* 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds 1995 supplement)).

One example of a useful algorithm is PILEUP. PILEUP uses a simplification of the progressive alignment method of Feng & Doolittle, *J. Mol. Evol.* 35:351-360, 1987. The method used is similar to the method described by Higgins & Sharp, *CABIOS* 5:151-153, 1989. Using PILEUP, a reference sequence is compared to other test sequences to determine the percent sequence identity relationship using the following parameters: default gap weight (3.00), default gap length weight (0.10), and weighted end gaps. PILEUP can be obtained from the GCG sequence analysis software package, e.g., version 7.0 (Devereaux et al., *Nuc. Acids Res.* 12:387-395, 1984.

Another example of algorithms that are suitable for determining percent sequence identity and sequence similarity are the BLAST and the BLAST 2.0 algorithm, which are described in Altschul et al., *J. Mol. Biol.* 215:403-410, 1990 and Altschul et al., *Nucleic Acids Res.* 25:3389-3402, 1977. Software for performing BLAST analyses is publicly available through the National Center for Biotechnology Information (ncbi.nlm.nih.gov). The BLASTN program (for nucleotide sequences) uses as defaults a word length (W) of 11, alignments (B) of 50, expectation (E) of 10, M=5, N=−4, and a comparison of both strands. An oligonucleotide is a linear polynucleotide sequence of up to about 100 nucleotide bases in length.

A polynucleotide or nucleic acid sequence refers to a polymeric form of nucleotide at least 10 bases in length. A recombinant polynucleotide includes a polynucleotide that is not immediately contiguous with both of the coding sequences with which it is immediately contiguous (one on the 5' end and one on the 3' end) in the naturally occurring genome of the organism from which it is derived. The term therefore includes, for example, a recombinant DNA which is incorporated into a vector; into an autonomously replicating plasmid or virus; or into the genomic DNA of a prokaryote or eukaryote, or which exists as a separate molecule (e.g., a cDNA) independent of other sequences. The nucleotides can be ribonucleotides, deoxyribonucleotides, or modified forms of either nucleotide. The term includes single- and double-stranded forms of DNA. An HA polynucleotide is a nucleic acid encoding a HA polypeptide; and an HA antibody polynucleotide is a nucleic acid encoding an antibody that specifically binds HA.

Pharmaceutically acceptable carriers: The pharmaceutically acceptable carriers of use are conventional. *Remington's Pharmaceutical Sciences*, by E. W. Martin, Mack Publishing Co., Easton, Pa., 19th Edition, 1995, describes compositions and formulations suitable for pharmaceutical delivery of the disclosed antibodies.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Pharmaceutical agent: A chemical compound or composition capable of inducing a desired therapeutic or prophylactic effect when properly administered to a subject or a cell. In some examples a pharmaceutical agent includes one or more of the disclosed antibodies.

Polypeptide: Any chain of amino acids, regardless of length or post-translational modification (e.g., glycosylation or phosphorylation). In one embodiment, the polypeptide is an HA polypeptide. In one embodiment, the polypeptide is a disclosed antibody or a fragment thereof. A "residue" refers to an amino acid or amino acid mimetic incorporated in a polypeptide by an amide bond or amide bond mimetic. A polypeptide has an amino terminal (N-terminal) end and a carboxy terminal end.

Purified: The term purified does not require absolute purity; rather, it is intended as a relative term. Thus, for example, a purified peptide preparation is one in which the peptide or protein (such as an antibody) is more enriched than the peptide or protein is in its natural environment within a cell. For example, other molecules, e.g. polypeptide, nucleic acid molecules that have been identified and separated and/or recovered from a component of its natural environment. In some examples, purified antibodies have been separated from one or more components of their natural environment In one embodiment, a preparation is purified such that the protein or peptide represents at least 50% of the total peptide or protein content of the preparation.

The antibodies that specifically bind HA as disclosed herien can be purified by any of the means known in the art. See for example *Guide to Protein Purification*, ed. Deutscher, Meth. Enzymol. 185, Academic Press, San Diego, 1990; and Scopes, *Protein Purification: Principles and Practice*, Springer Verlag, New York, 1982. Substantial purification denotes purification from other proteins, antibodies, or cellular components. A substantially purified protein is at least 60%, 70%, 80%, 90%, 95% or 98% pure. Thus, in one specific, non-limiting example, a substantially purified protein is 90% free of other proteins or cellular components.

Outbreak: As used herein, an influenza virus "outbreak" refers to a collection of virus isolates from within a single country in a given year.

Recombinant: A recombinant nucleic acid is one that has a sequence that is not naturally occurring or has a sequence that is made by an artificial combination of two otherwise separated segments of sequence. This artificial combination is often accomplished by chemical synthesis or, more commonly, by the artificial manipulation of isolated segments of nucleic acids, e.g., by genetic engineering techniques.

Sequence identity: The similarity between amino acid sequences is expressed in terms of the similarity between the sequences, otherwise referred to as sequence identity. Sequence identity is frequently measured in terms of percentage identity (or similarity or homology); the higher the percentage, the more similar the two sequences are. Homologs or variants of a polypeptide will possess a relatively high degree of sequence identity when aligned using standard methods.

Methods of alignment of sequences for comparison are well known in the art. Various programs and alignment algorithms are described in: Smith and Waterman, *Adv. Appl. Math.* 2:482, 1981; Needleman and Wunsch, *J. Mol. Biol.* 48:443, 1970; Pearson and Lipman, *Proc. Natl. Acad. Sci. U.S.A.* 85:2444, 1988; Higgins and Sharp, *Gene* 73:237, 1988; Higgins and Sharp, *CABIOS* 5:151, 1989; Corpet et al., *Nucleic Acids Research* 16:10881, 1988; and Pearson and Lipman, *Proc. Natl. Acad. Sci. U.S.A.* 85:2444, 1988. Altschul et al., *Nature Genet.* 6:119, 1994, presents a detailed consideration of sequence alignment methods and homology calculations.

The NCBI Basic Local Alignment Search Tool (BLAST) (Altschul et al., *J. Mol. Biol.* 215:403, 1990) is available from several sources, including the National Center for Biotechnology Information (NCBI, Bethesda, Md.) and on the internet, for use in connection with the sequence analysis programs blastp, blastn, blastx, tblastn and tblastx. A description of how to determine sequence identity using this program is available on the NCBI website on the internet. The BLASTP program (for amino acid sequences) uses as defaults a word length (W) of 3, and expectation (E) of 10, and the BLOSUM62 scoring matrix (see Henikoff & Henikoff, *Proc. Natl. Acad. Sci. USA* 89:10915, 1989).

Homologs and variants of a $V_L$ or a $V_H$ of an antibody that specifically binds a polypeptide are typically characterized by possession of at least about 75%, for example at least about 80%, 85%, 90%, 91%, 92%, 93%, 94%, 95%, 96%, 97%, 98% or 99% sequence identity counted over the full length alignment with the amino acid sequence of interest. Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

Specifically bind: When referring to an antibody, refers to a binding reaction which determines the presence of a target protein, peptide, or polysaccharide in the presence of a heterogeneous population of proteins and other biologics. Thus, under designated conditions, an antibody binds preferentially to a particular target protein, peptide or polysaccharide (such as an antigen of a pathogen, for example HA) and do not bind in a significant amount to other proteins or polysaccharides present in the sample or subject. Specific binding can be determined by methods known in the art. With reference to an antibody antigen complex, specific binding of the antigen and antibody has a $K_d$ of less than about $10^{-6}$ Molar, $10^{-7}$ Molar, $10^{-8}$ Molar, $10^{-9}$, or even less than about $10^{-10}$ Molar. Generally, an antibody specifically binds the target antigen with a $K_d$ of is less than $10^{-8}$ Molar.

Therapeutic agent: Used in a generic sense, it includes treating agents, prophylactic agents, and replacement agents. A therapeutic agent is used to ameliorate a specific set of conditions in a subject with a disease or a disorder.

Therapeutically effective amount: A quantity of a specific substance, such as a disclosed antibody, sufficient to achieve a desired effect in a subject being treated. For instance, this can be the amount necessary to inhibit influenza virus replication or treat the flu. In several embodiments, a therapeutically effective amount is the amount necessary to reduce a sign or symptom of the flu, and/or to decrease viral titer in a subject. When administered to a subject, a dosage will generally be used that will achieve target tissue concentrations that has been shown to achieve a desired in vitro effect.

Vector: A nucleic acid molecule as introduced into a host cell, thereby producing a transformed host cell. A vector may include nucleic acid sequences that permit it to replicate in a host cell, such as an origin of replication. A vector may also include one or more selectable marker genes and other genetic elements known in the art.

Virus: Microscopic infectious organism that reproduces inside living cells. A virus consists essentially of a core of a single nucleic acid surrounded by a protein coat, and has the ability to replicate only inside a living cell. "Viral replication" is the production of additional virus by the occurrence of at least one viral life cycle. A virus may subvert the host cells' normal functions, causing the cell to behave in a manner determined by the virus. For example, a viral infection may result in a cell producing a cytokine, or responding to a cytokine, when the uninfected cell does not normally do so.

Antibodies that Specifically Bind Influenza HA

Antibodies and antigen binding fragments of these antibodies are disclosed herein that specifically bind HA of influenza virus. In some embodiments, the antibody or antigen binding fragment specifically binds to HA of H1N1 influenza. In some embodiments, it specifically binds the HA of H5N1 influenza. In some embodiments, the antibody or antigen binding fragment specifically binds the HA of both H1N1 and H5N1. In some embodiments, the antibody or antigen binding fragment also specifically binds to the HA of H3N2. In further embodiments, the antibody specifically binds H1N1, H5N1 and/or H3N2. Thus, in some embodiments, the antibody, antibody fragment binds to the HA domain of two or more different subclasses of influenza A, such as H1N1, H5N1 and/or H3N2. These antibodies are broadly cross reactive. In some embodiments, the antibodies bind the stem of HA.

The antibody, antibody fragment can cross-react with two different influenza strains/subtypes (e.g., two or more different strains of H1N1 such as the 2009 pandemic strain or the 1918 pandemic strain). In some cases, the antibody, antibody fragment or peptide may cross-react with three or more, five or more or ten or more different influenza strains and/or subtypes. Thus, the antibody, antibody fragment binds to the HA domain (and in some cases can neutralize) two or more of the following H1N1 strains: Pandemic (H1N1) 2009; A/Brevig mission/1/18(H1N1) 1918; and A/Brisbane/59/07 (H1N1) 2007. Some antibodies, antibody fragments immunospecifically bind to a particular type of influenza, e.g., H1N1 or H5N1. In some cases the antibody, antibody fragment immunospecifically binds to an influenza virus, e.g., influenza A, HA domain. In some cases the antibody, antibody fragment or peptide binds or binds and neutralizes a H1N1 strain and/or subtype and an H1N5 strain and/or subtype. In some non-limiting examples, the purified antibody or antibody fragment binds to at least three H1 influenza strains selected from the strains in panel A of FIG. 3.

In specific non-limiting embodiments, the isolated antibody binds the HA stalk. The HA stalk includes portions of the HA1 and HA2 subunits of HA. Thus, the antibody can bind epitopes on HAL epitopes on HA2, or an epitope found on a complex of HA1 and HA2.

In other non-limiting embodiments, the isolated antibody binds the HA globular head. In further non-limiting embodiments, the strain and/or subtype antibody neutralizes one or more strains and/or subtypes of H1N1 influenza, one or more strains and/or subtypes of H5N1 influenza or one or more strains and/or subtypes of both H1N1 and H5N1 influenza. In yet other non-limiting embodiments, the antibody has hemagglutination inhibition activity. In additional embodiments, the antibody binds one (e.g., 2, 3, 4 or 5) or more of: Pandemic (H1N1) 2009; A/Brevig mission/1/18(H1N1) 1918; and A/Brisbane/59/07(H1N1) 2007A/Indonesia/5/05 (H5N1) 2005; A/Brisbane10/07 (H3N2) 2007.

In other embodiments, the antibody is an IgG antibody; such an IgG1 antibody; is an IgG1, kappa antibody; is an IgG1, lambda antibody, or a IgM, IgA, IgD or IgE antibody. The antibody can be a humanized antibody or a fully human antibody. Antigen binding fragments of these antibodies are also provided herein. In some embodiments, that antigen binding is selected from a Fab, a $F(ab')_2$ fragment, a Fd fragment, an Fv fragment, a scFv, and a domain antibody (dAb) fragment.

Generally, an anti-influenza antibody immunospecifically bind an epitope specific to an HA domain of an influenza A virus and does not specifically bind to other polypeptides. Isolated monoclonal antibodies that specifically bind HA are disclosed herein. Also disclosed herein are compositions including these monoclonal antibodies and a pharmaceutically acceptable carrier. Nucleic acids encoding these antibodies, expression vectors comprising these nucleic acids, and isolated host cells that express the nucleic acids are also provided.

Compositions comprising the monoclonal antibodies specific for HA can be used for research, diagnostic and therapeutic purposes. In one embodiment, the monoclonal antibodies disclosed herein can be used to diagnose or treat a subject having an influenza infection. In another embodiment, the antibodies can be used to determine viral titer in a subject. The antibodies disclosed herein also can be used to study the biology of the human immunodeficiency virus.

Naturally-occurring antibodies are immunoglobulin molecules comprised of four polypeptide chains, two heavy (H) chains and two light (L) chains inter-connected by disulfide bonds. Each heavy chain is comprised of a heavy chain variable region (VH) and a heavy chain constant region. The heavy chain constant region is comprised of three domains, CH1, CH2 and CH3. Each light chain is comprised of a light chain variable region (VL) and a light chain constant region. The light chain constant region is comprised of one domain, CL. The VH and VL regions can be further subdivided into regions of hypervariability, called complementarity determining regions (CDR), interspersed with regions that are more conserved, called framework regions (FR). Each VH and VL is composed of three CDRs and four FRs, arranged from amino-terminus to carboxy-terminus in the following order: FR1, CDR1, FR2, CDR2, FR3, CDR3, FR4. CDRs and FRs may be defined according to Kabat or IMGT. Thus, antibodies are provided herein that include the CDRs of the variable domains presented in FIG. 12. Antibodies are also provided herein that include the CDRs presented in FIG. 12.

Each CDR can include amino acid residues from a complementarity determining region as defined by Kabat (i.e. about residues 24-34 (CDR-L1), 50-56 (CDR-L2) and 89-97 (CDR-L3) in the light chain variable domain (SEQ ID NOS 11, 31, 51, 71, 91, 111, 131, 151, 171, 191, 211, 231, 251, 271, 291, 311, 331, 351, 371, 391, 411, 431, 451, 471, 491, 511, 531, 551, 571, 591, 611, 631, 651, 671, 691, 711, 731, 751, 771, 791, 811, 831, 851, 871, 891, 911, 931, 951, 971, 991, 1011, 1031, 1051, 1071, 1091, 1111, 1131, 1151, 1171, 1191, 1211, 1231, 1251, 1271, 1291, 1311, 1331, 1351, 1371, and 1391) and 31-35 (CDR-H1), 50-65 (CDR-H2) and 95-102 (CDR-H3) in the heavy chain variable domain (SEQ ID NOS 1, 21, 41, 61, 81, 101, 121, 141, 161, 181, 201, 221, 241, 261, 281, 301, 321, 341, 361, 381, 401, 421, 441, 461, 481, 501, 521, 541, 561, 581, 601, 621, 641, 661, 681, 701, 721, 741, 761, 781, 801, 821, 841, 861, 881, 901, 921, 941, 961, 981, 1001, 1021, 1041, 1061, 1081, 1101, 1121, 1141, 1161, 1181, 1201, and 1221, 1241, 1261, 1281, 1301, 1321, 1341, 1361, and 1381) (Kabat et al., (1991) *Sequences of Proteins of Immunological Interest,* 5th Edition, U.S. Department of Health and Human Services, Public Health Service, National Institutes of Health, Bethesda, Md. (NIH Publication No. 91-3242, which is specifically incorporated herein by reference in its entirety). In some embodiments, the antibody includes those residues from a hypervariable loop (i.e. about residues 26-32 (CDR-L1), 50-52 (CDR-L2) and 91-96 (CDR-L3) in the light chain variable domain (SEQ ID NO:1) and 26-32 (CDR-H1), 53-55 (CDR-H2) and 96-101 (CDR-H3) in the heavy chain variable domain (SEQ ID NO:2), see Chothia and Lesk J. Mol. Biol. 196:901-917 (1987)). In some instances, a complementarity determining region can include amino acids from both a CDR region defined according to Kabat and a hypervariable loop.

Framework regions are those variable domain residues other than the CDR residues. Each variable domain typically has four FRs identified as FR1, FR2, FR3 and FR4. If the CDRs are defined according to Kabat, the light chain FR residues are positioned at about residues 1-23 (LCFR1), 35-49 (LCFR2), 57-88 (LCFR3), and 98-107 (LCFR4) of SEQ ID NO:1) and the heavy chain FR residues are positioned about at residues 1-30 (HCFR1), 36-49 (HCFR2), 66-94 (HCFR3), and 103-113 (HCFR4) of SEQ ID NO:2. If the CDRs comprise amino acid residues from hypervariable loops, the light chain FR residues are positioned about at residues 1-25 (LCFR1), 33-49 (LCFR2), 53-90 (LCFR3), and 97-107 (LCFR4) in the light chain (SEQ ID NO:1) and the heavy chain FR residues are positioned about at residues 1-25 (HCFR1), 33-52 (HCFR2), 56-95 (HCFR3), and 102-113 (HCFR4) in the heavy chain (SEQ ID NO:2). In some instances, when the CDR comprises amino acids from both a CDR as defined by Kabat and those of a hypervariable loop, the FR residues will be adjusted accordingly.

The monoclonal antibodies can also include heavy and light chain variable domains including a CDR1, CDR2 and CDR3 with reference to the IMGT numbering scheme (unless the context indicates otherwise). The person of ordinary skill in the art will understand that various CDR numbering schemes (such as the Kabat, Chothia or IMGT numbering schemes) can be used to determine CDR positions. This numbering also can be used in reference to the heavy and light chains sequences disclosed herein. FIG. 12 provides the CDRs and framework regions according to the IMGT numbering scheme.

In certain embodiments, the anti-influenza antibodies are isolated and/or purified and/or pyrogen free antibodies. The present anti-influenza antibodies include at least one antigen binding domain that comprises at least one complementarity determining region (CDR1, CDR2 and CDR3). In one embodiment, the anti-influenza antibodies or antigen binding fragments thereof include a $V_H$ that includes at least one $V_H$ CDR (e.g., CDR-H1, CDR-H2 or CDR-H3). In another embodiment, the anti-influenza antibodies include a $V_L$ that comprises at least one $V_L$ CDR (e.g., CDR-L1, CDR-L2 or CDR-L3). In further embodiments the anti-influenza antibodies or antigen binding fragments thereof include three $V_H$ CDRs (e.g., CDR-H1, CDR-H2 or CDR-H3) and or three $V_L$ CDRs (e.g., CDR-L1, CDR-L2 or CDR-L3)

Figure 12:
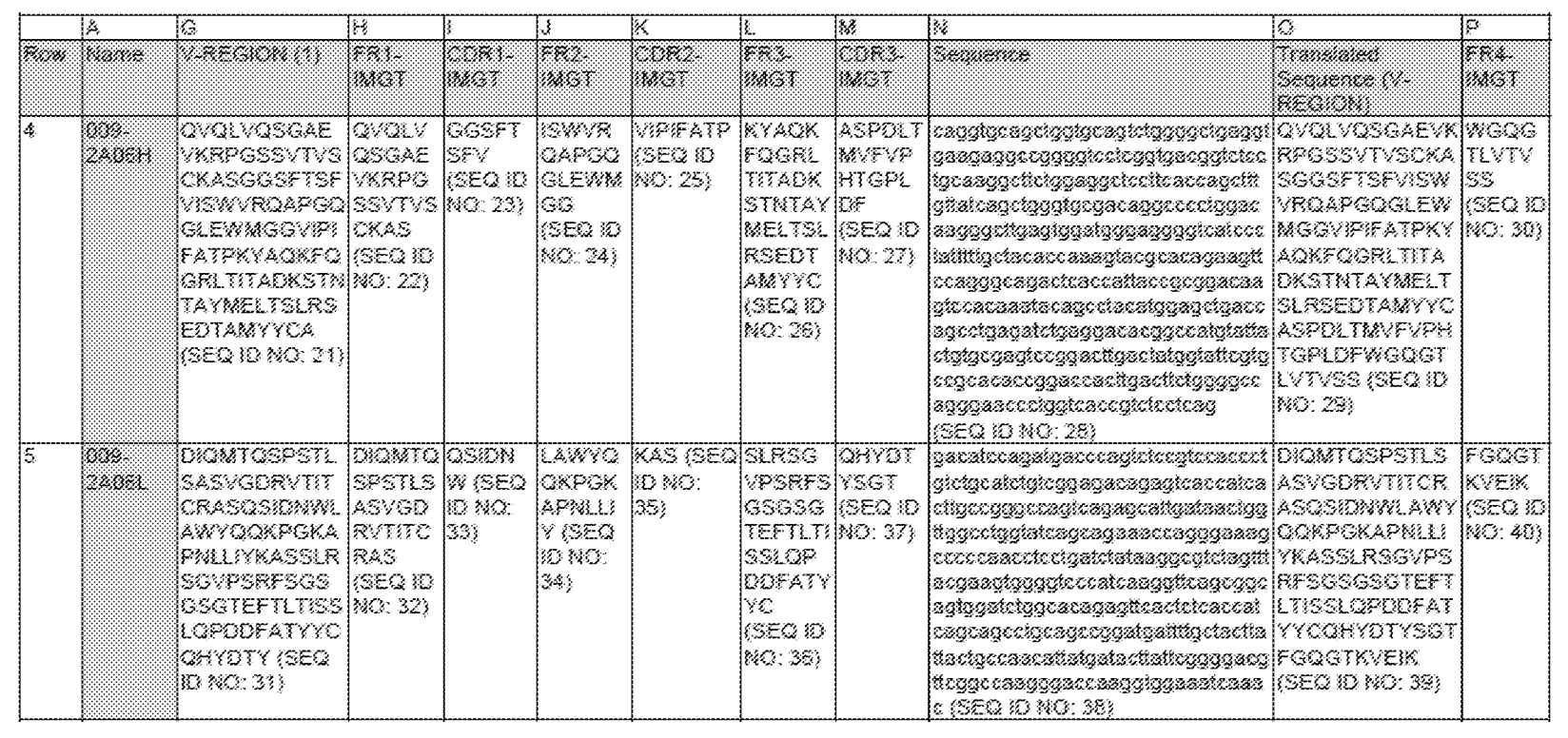
Figure 12:
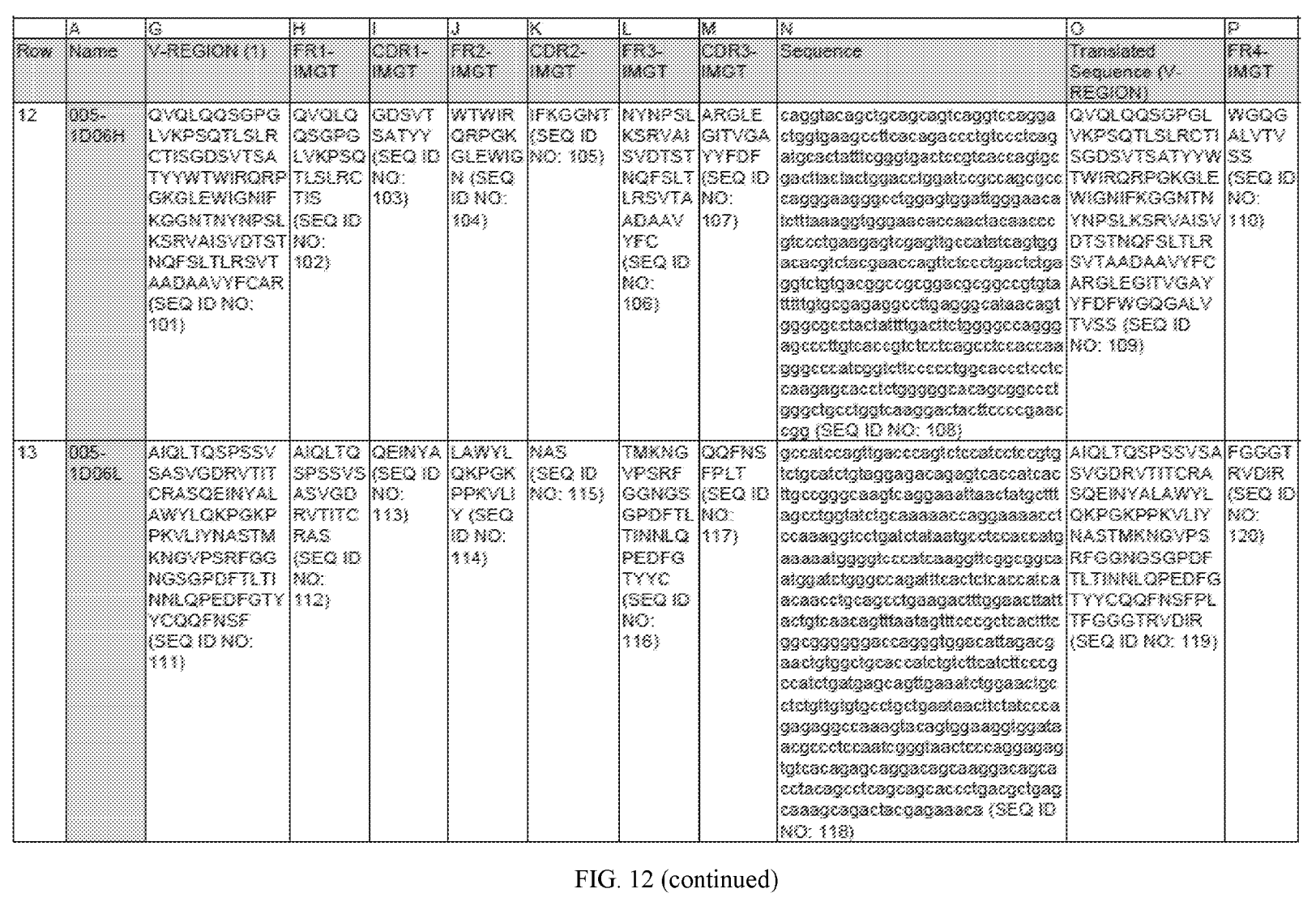
Figure 12:
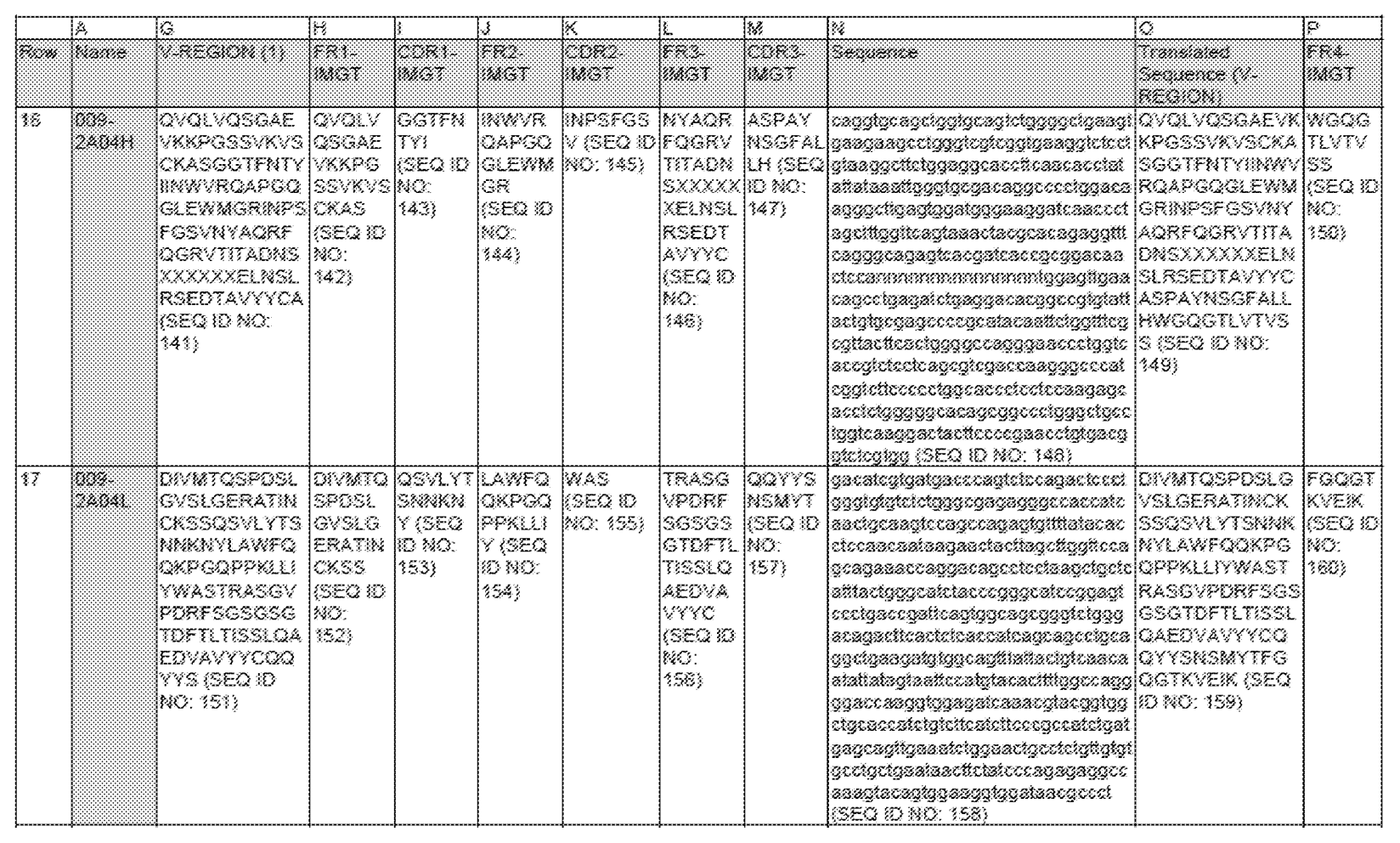
Figure 12:
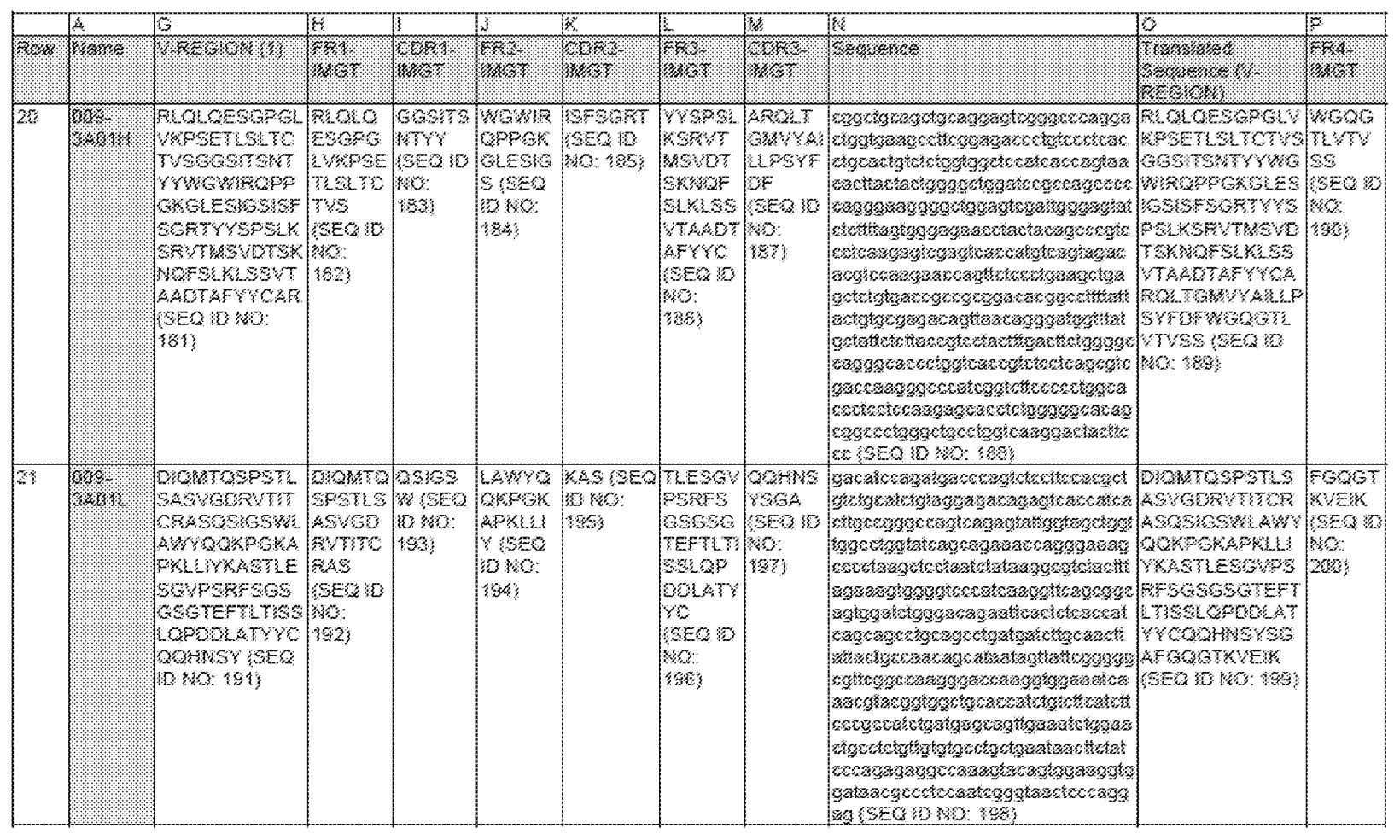
Figure 12:
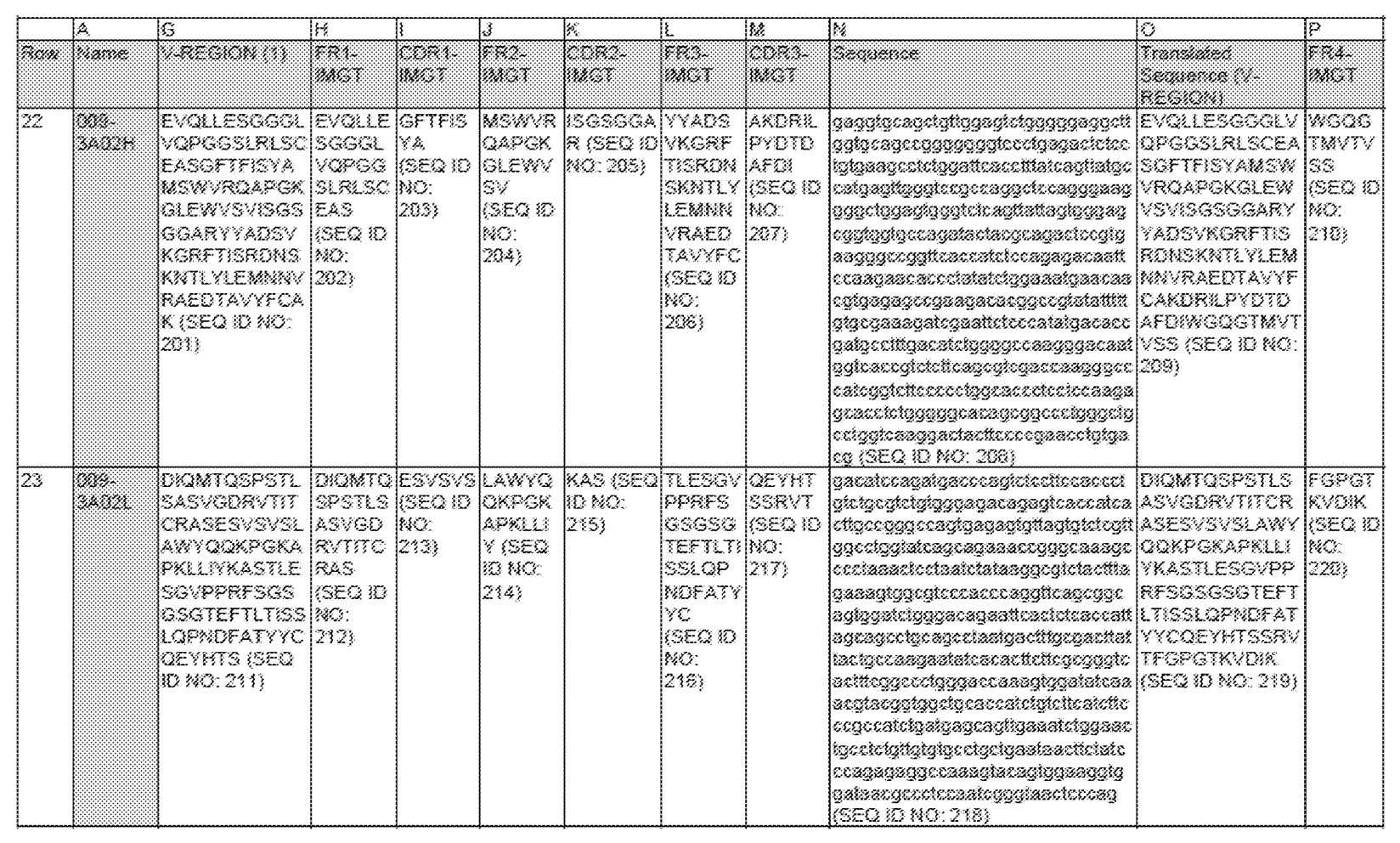
Figure 12:
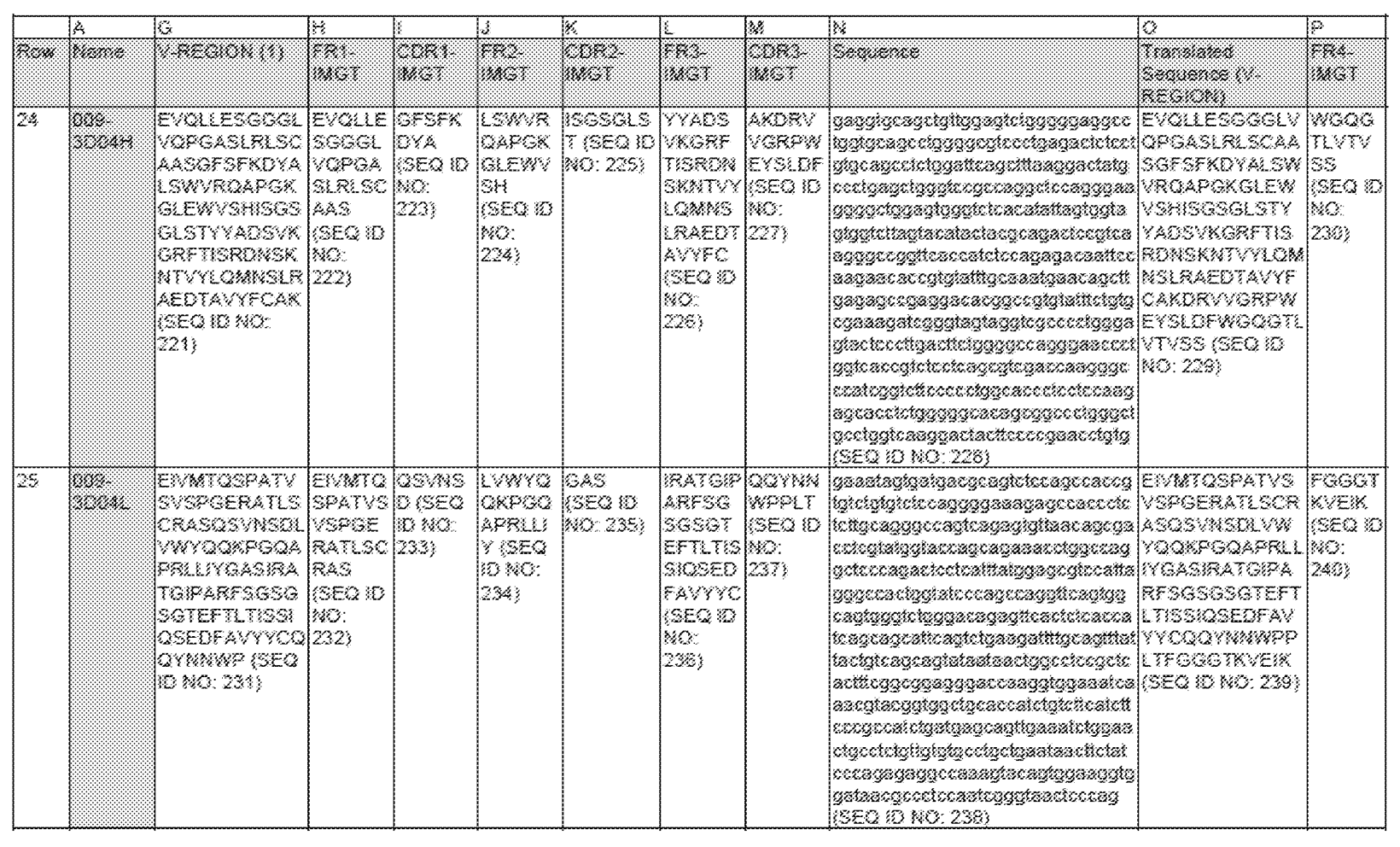
Figure 12:
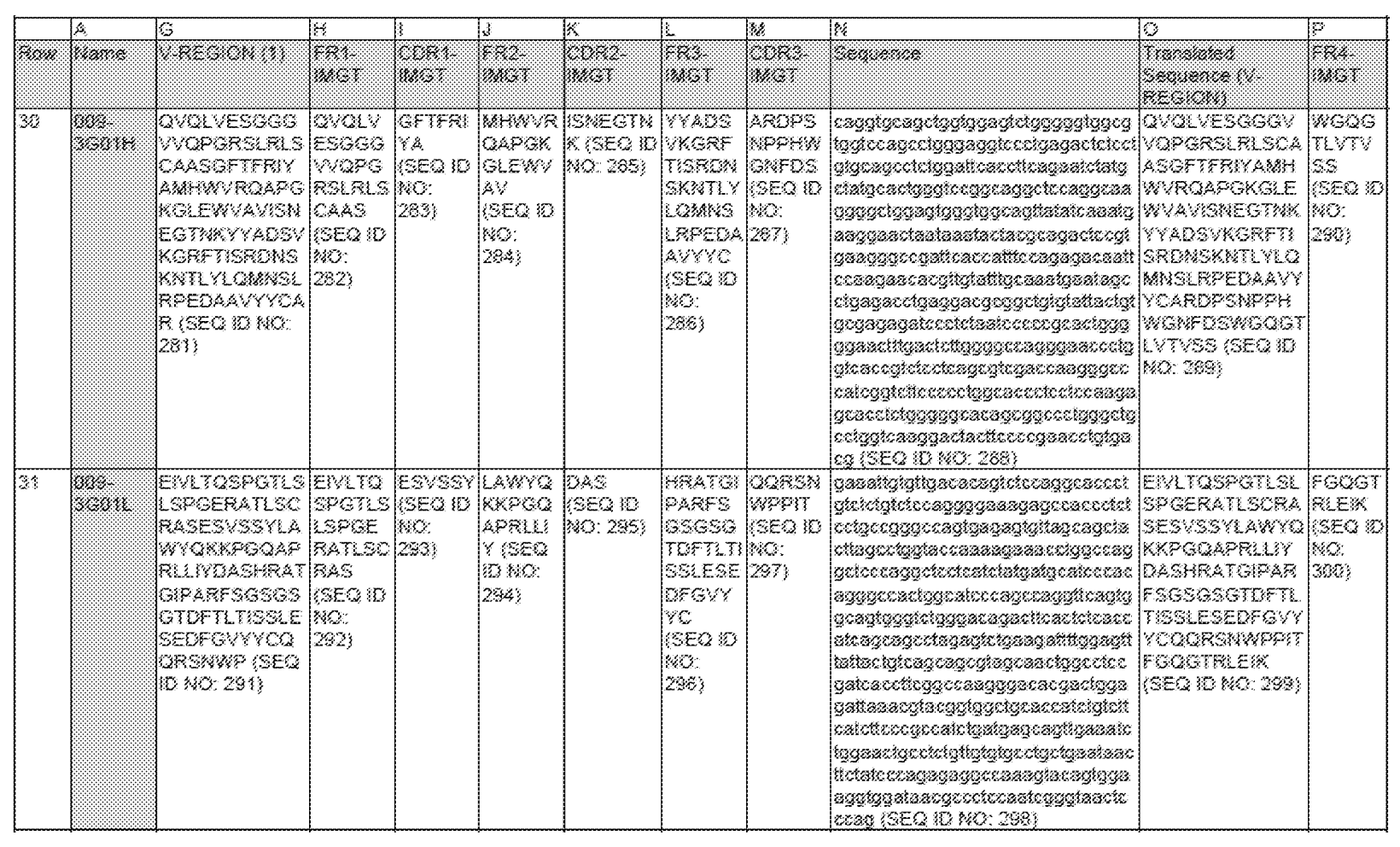
Figure 12:
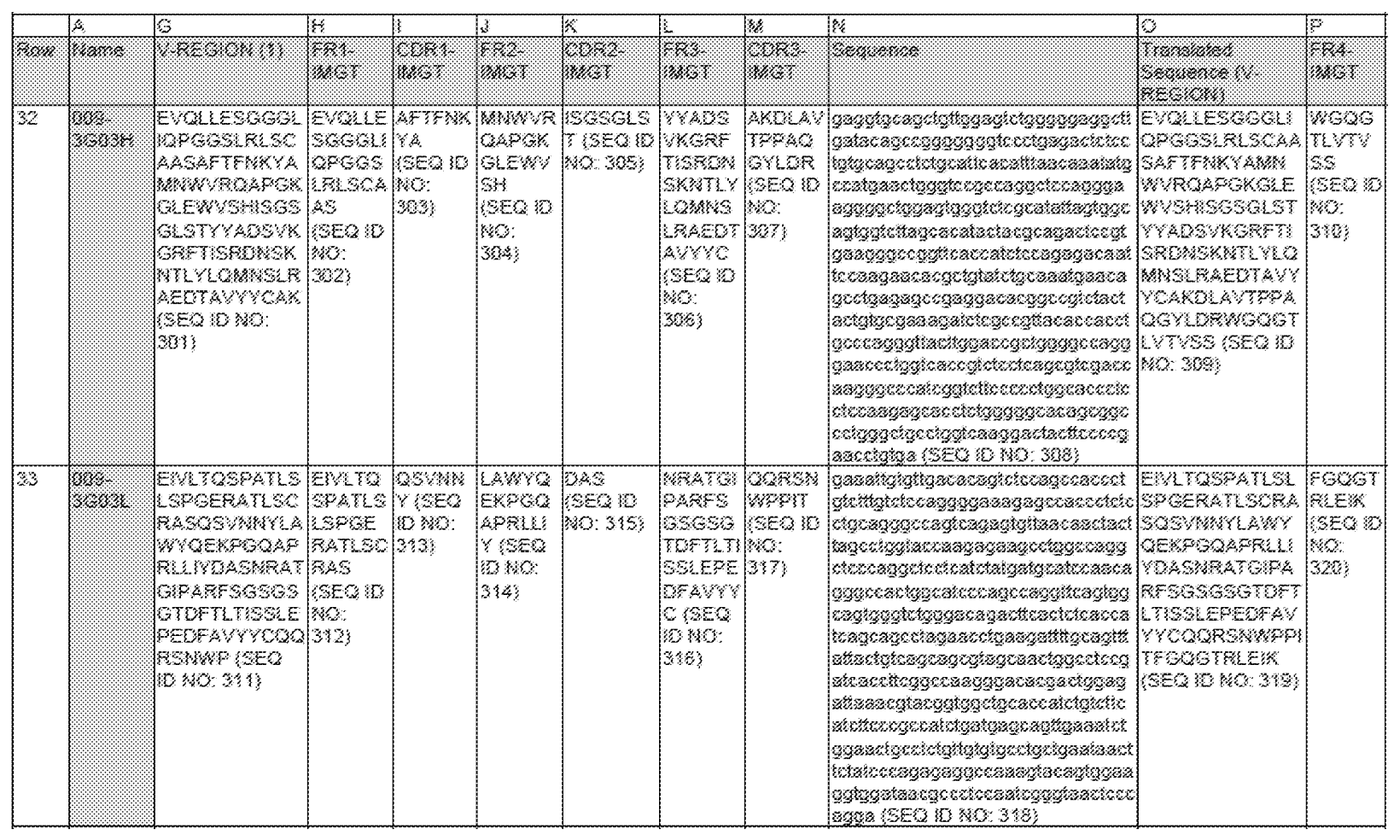
Figure 12:
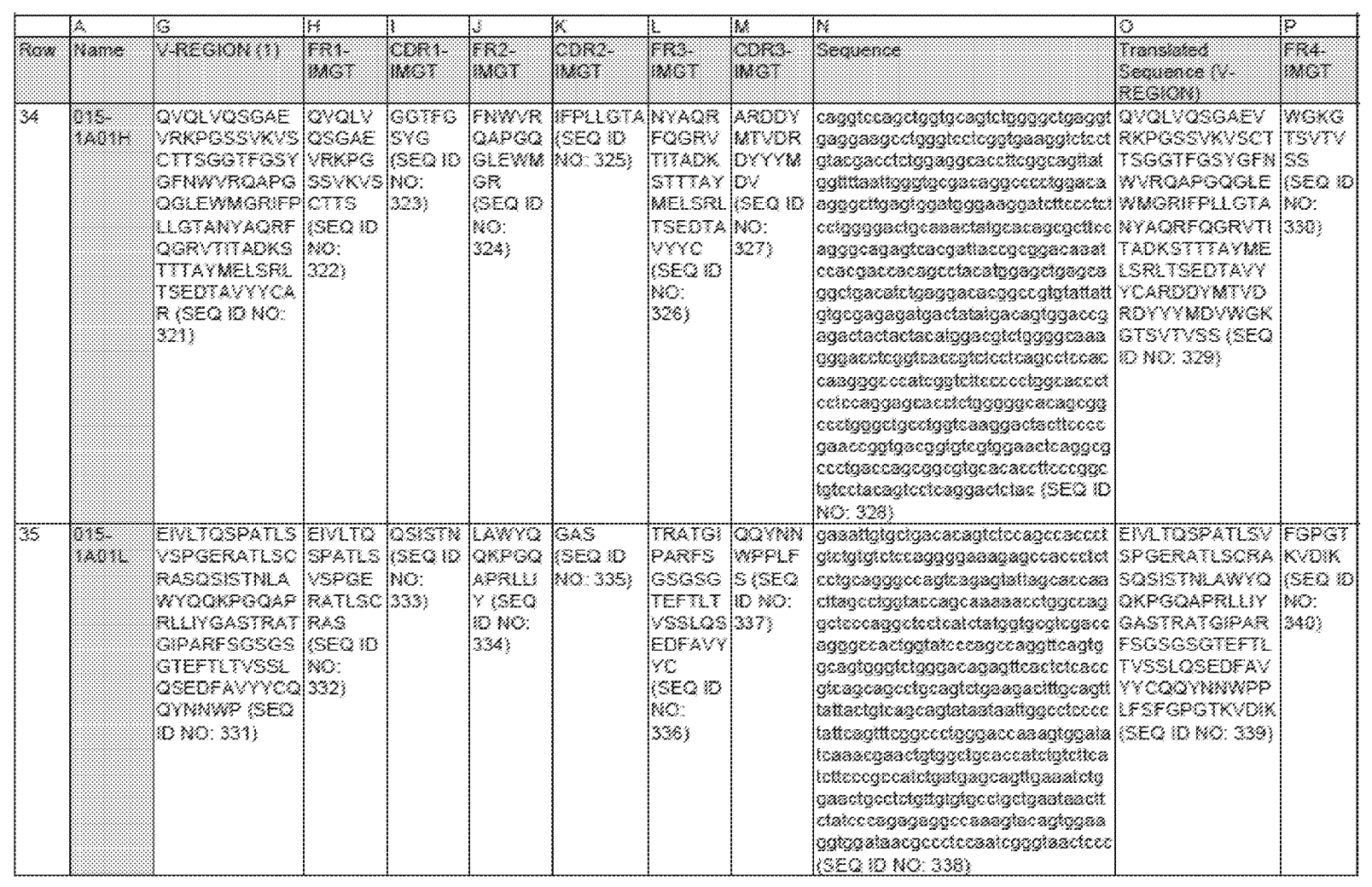
Figure 12:
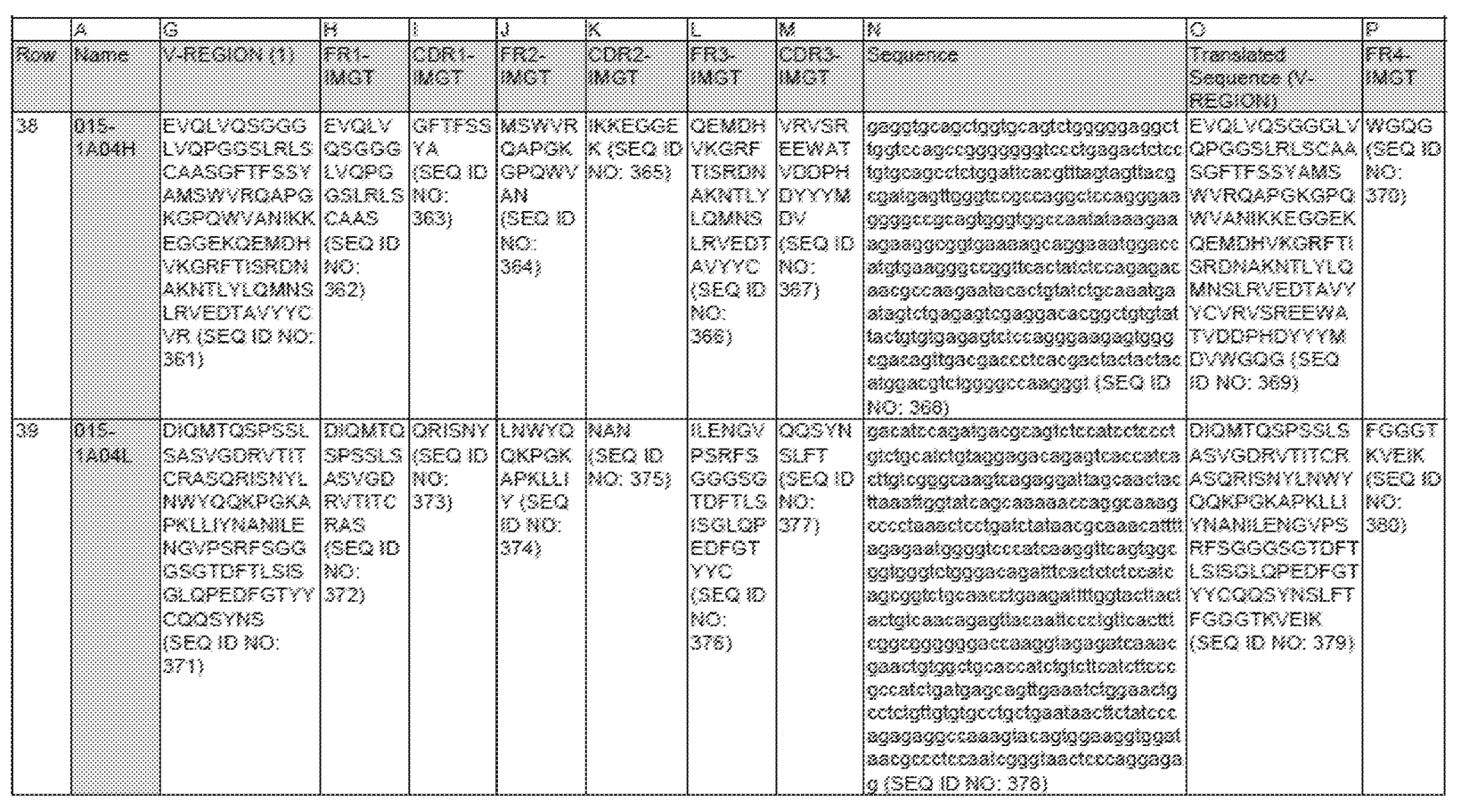
Figure 12:
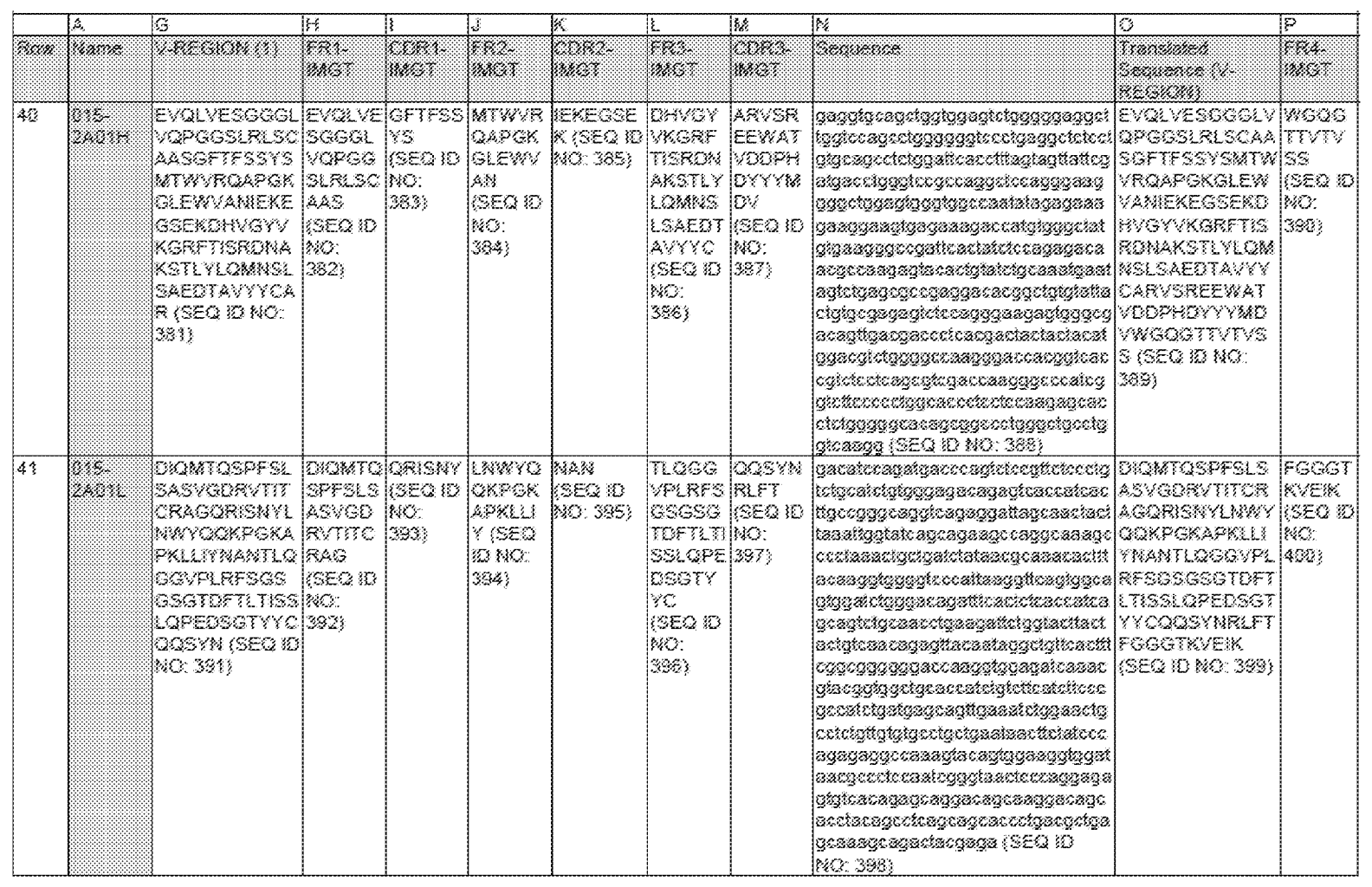
Figure 12:
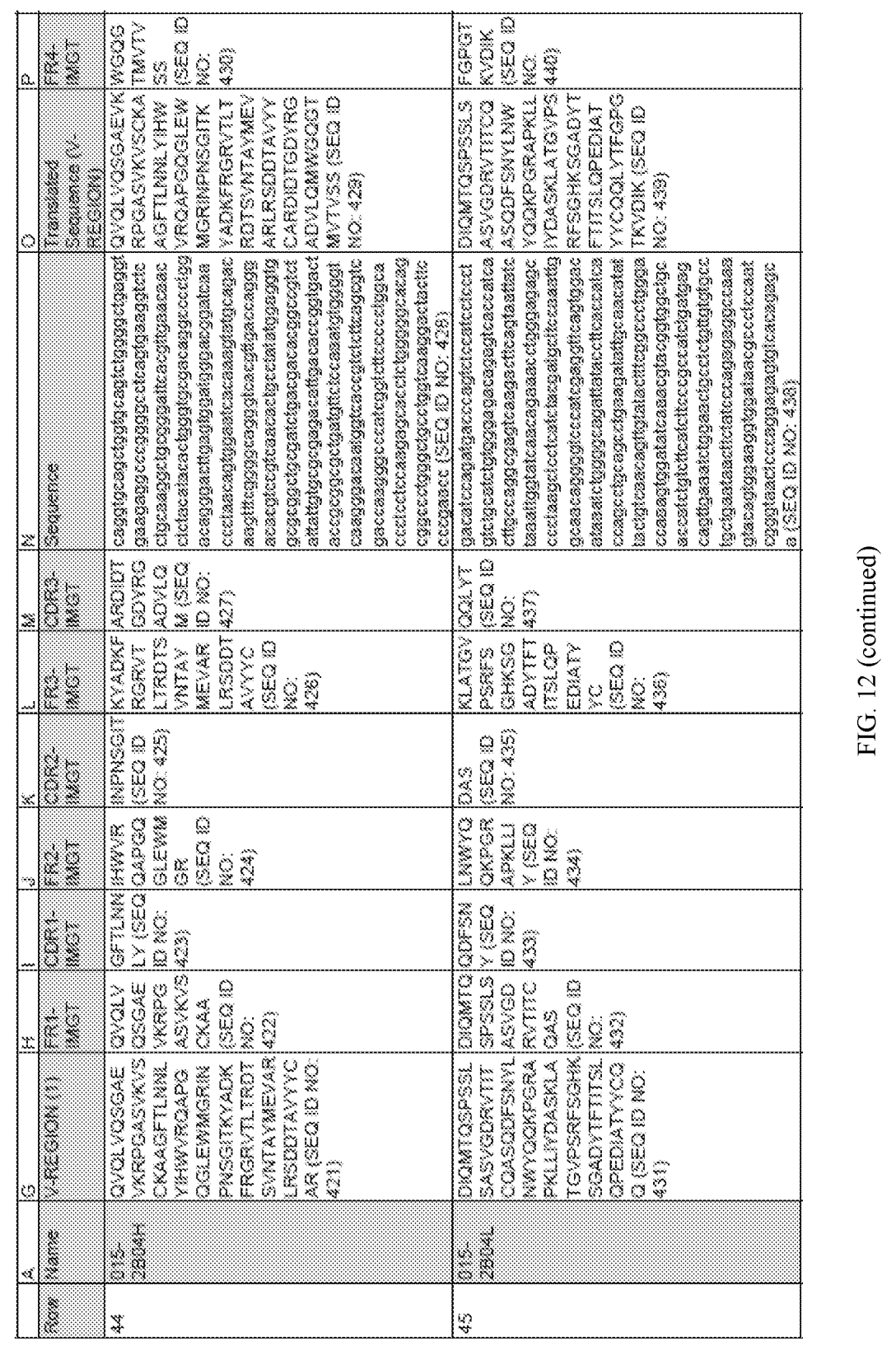
Figure 12:
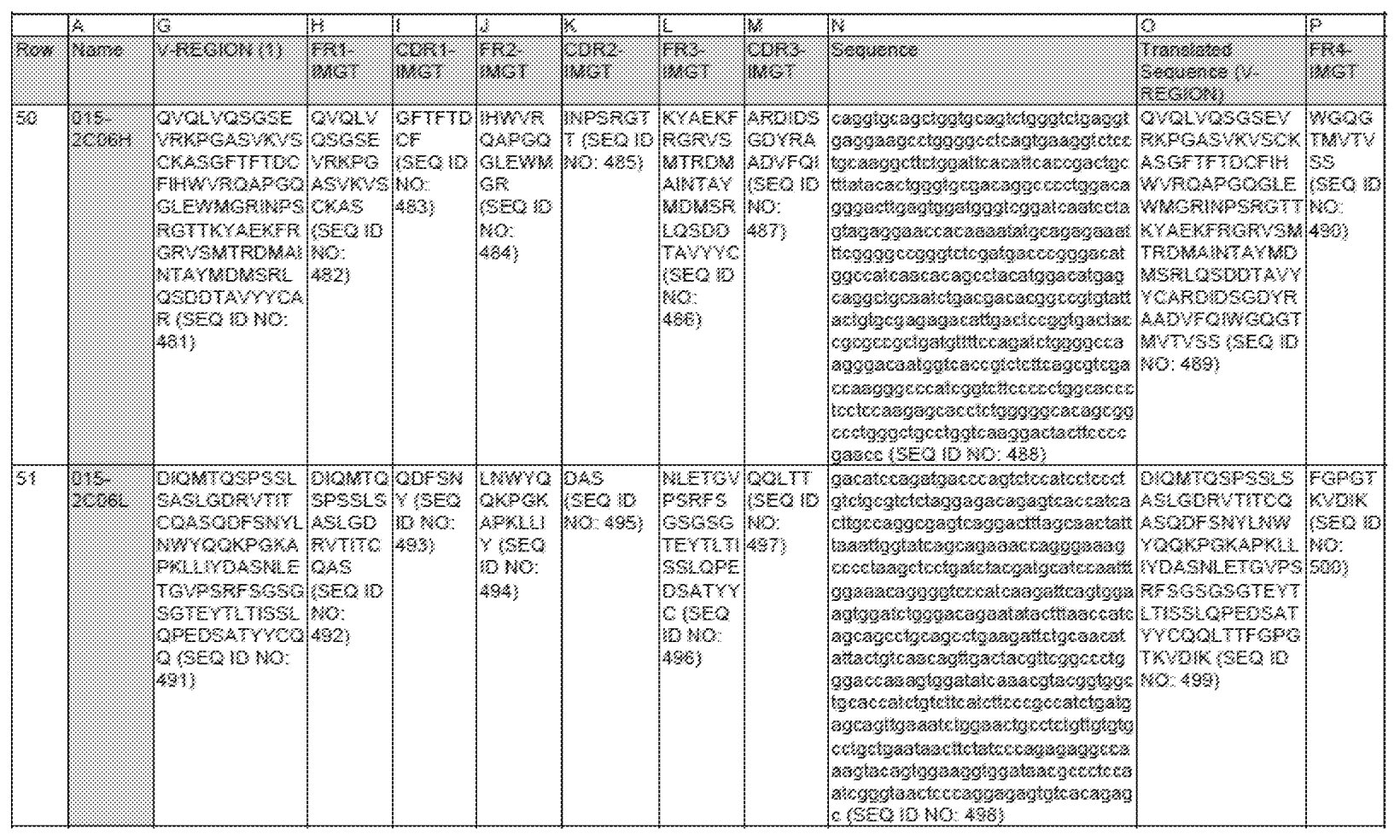
Figure 12:
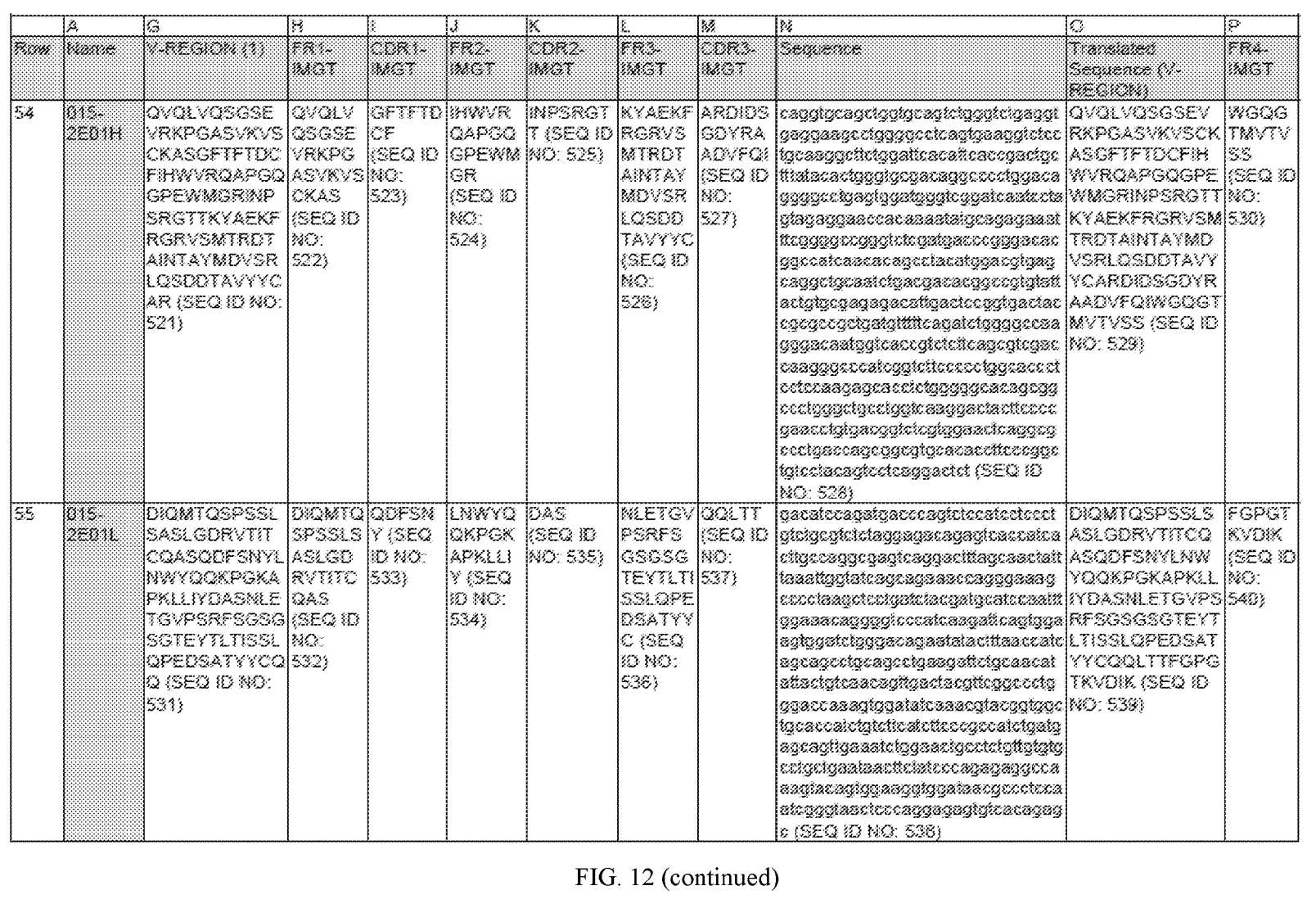
Figure 12:
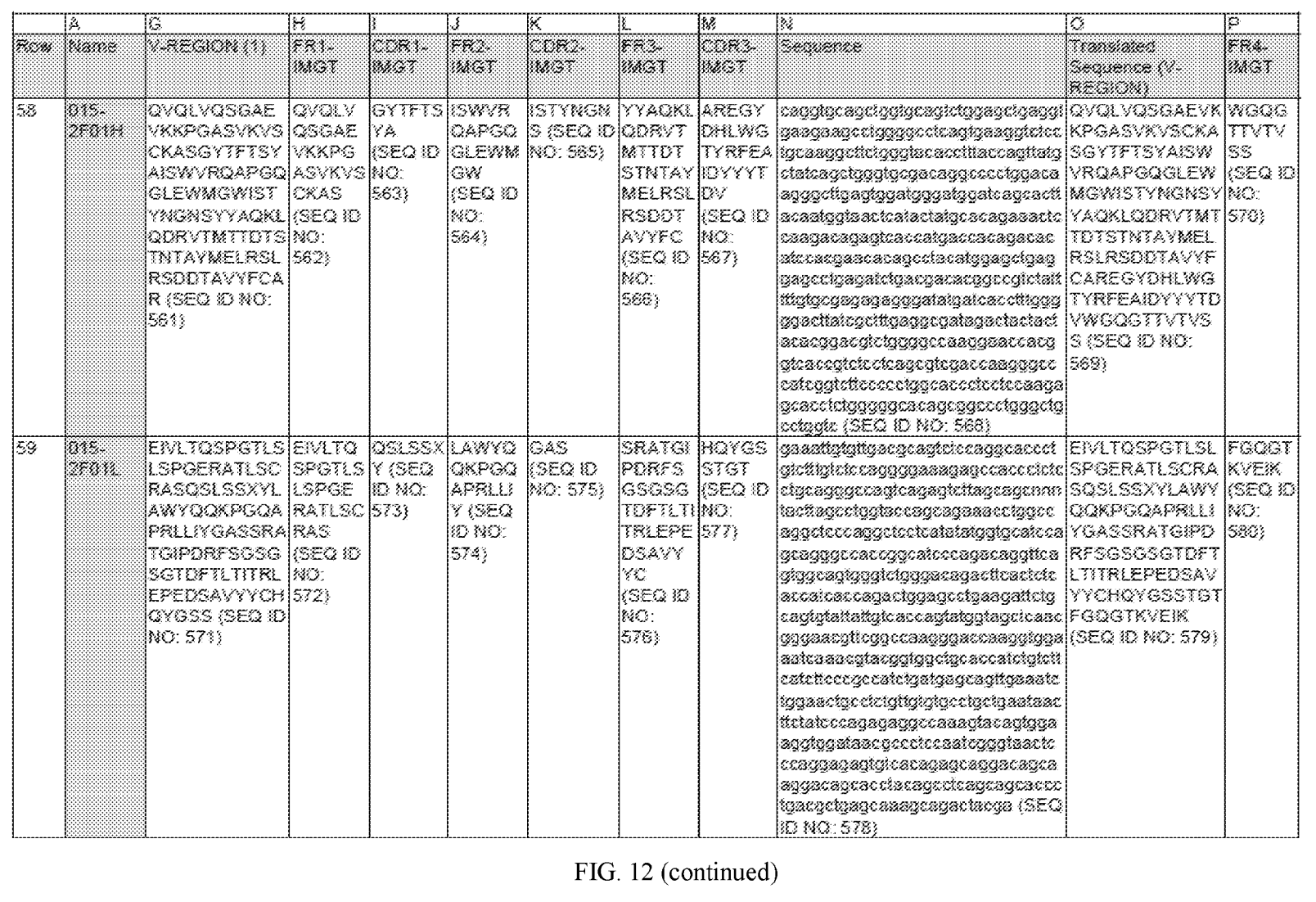
Figure 12:
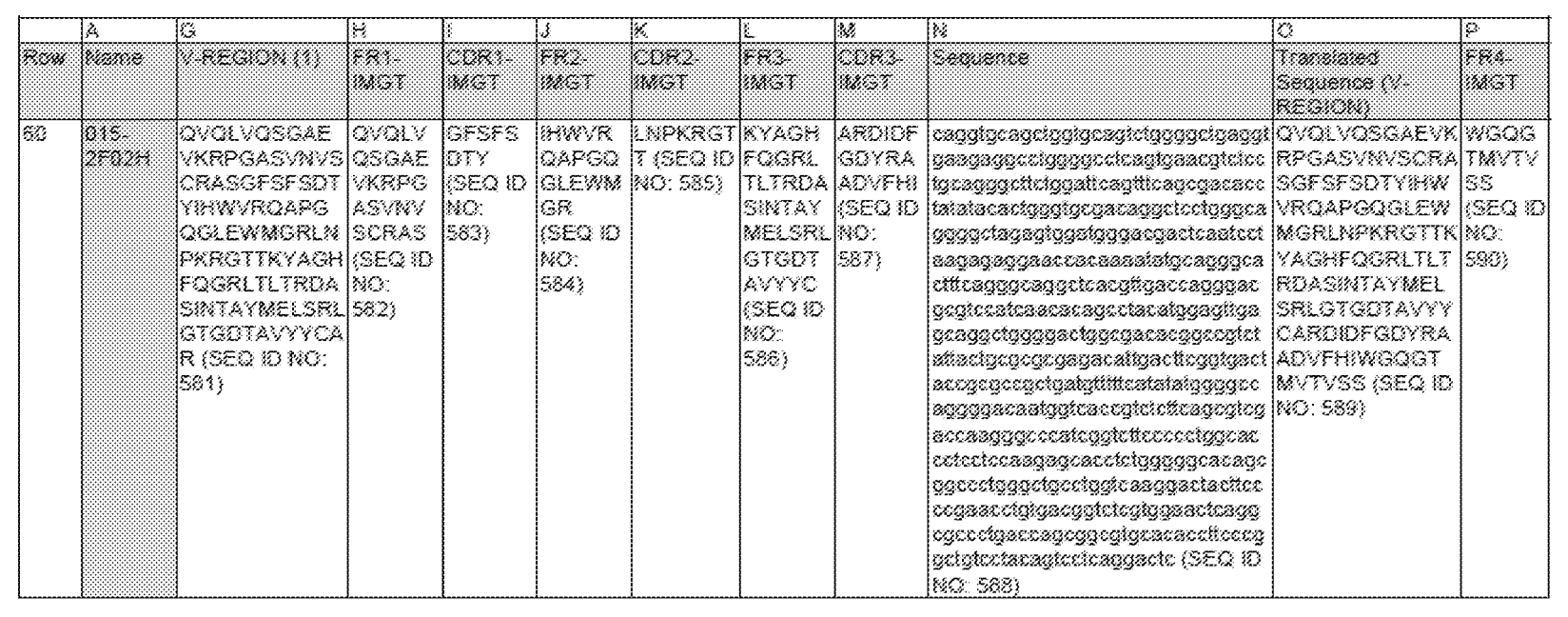
Figure 12:
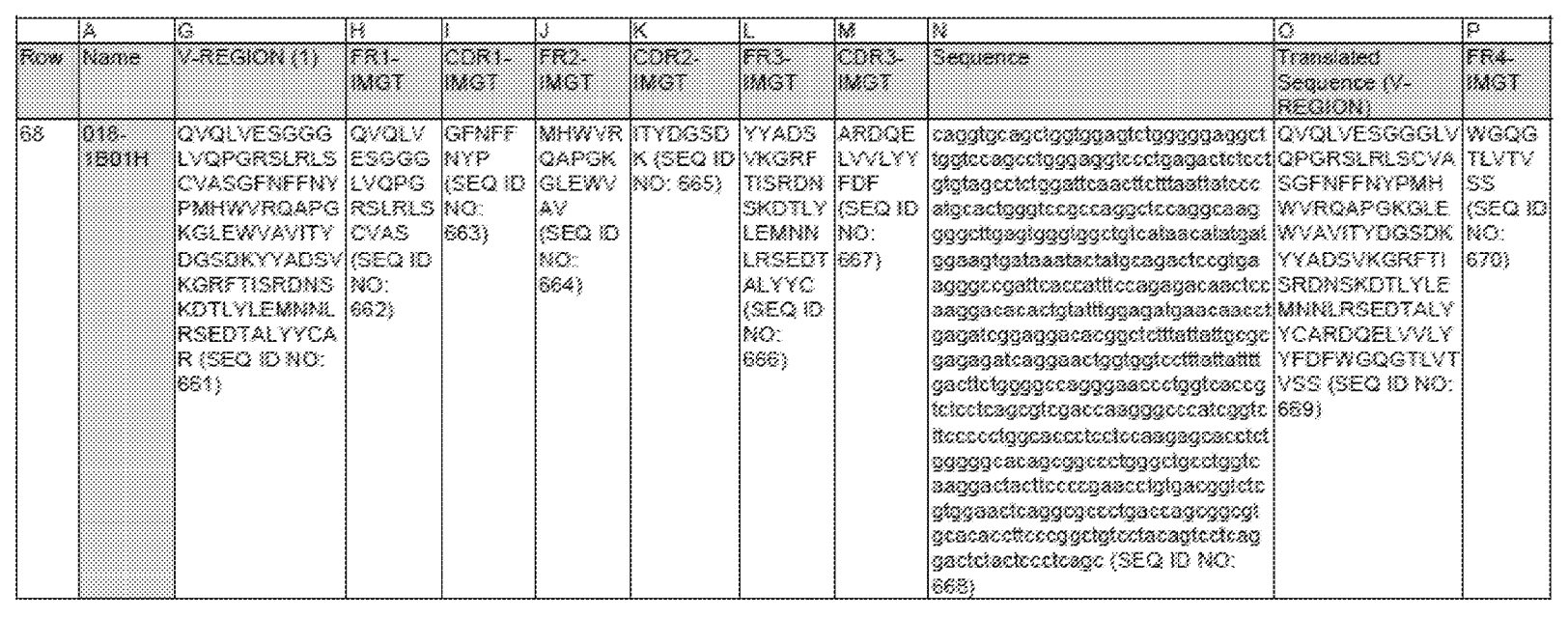
Figure 12:
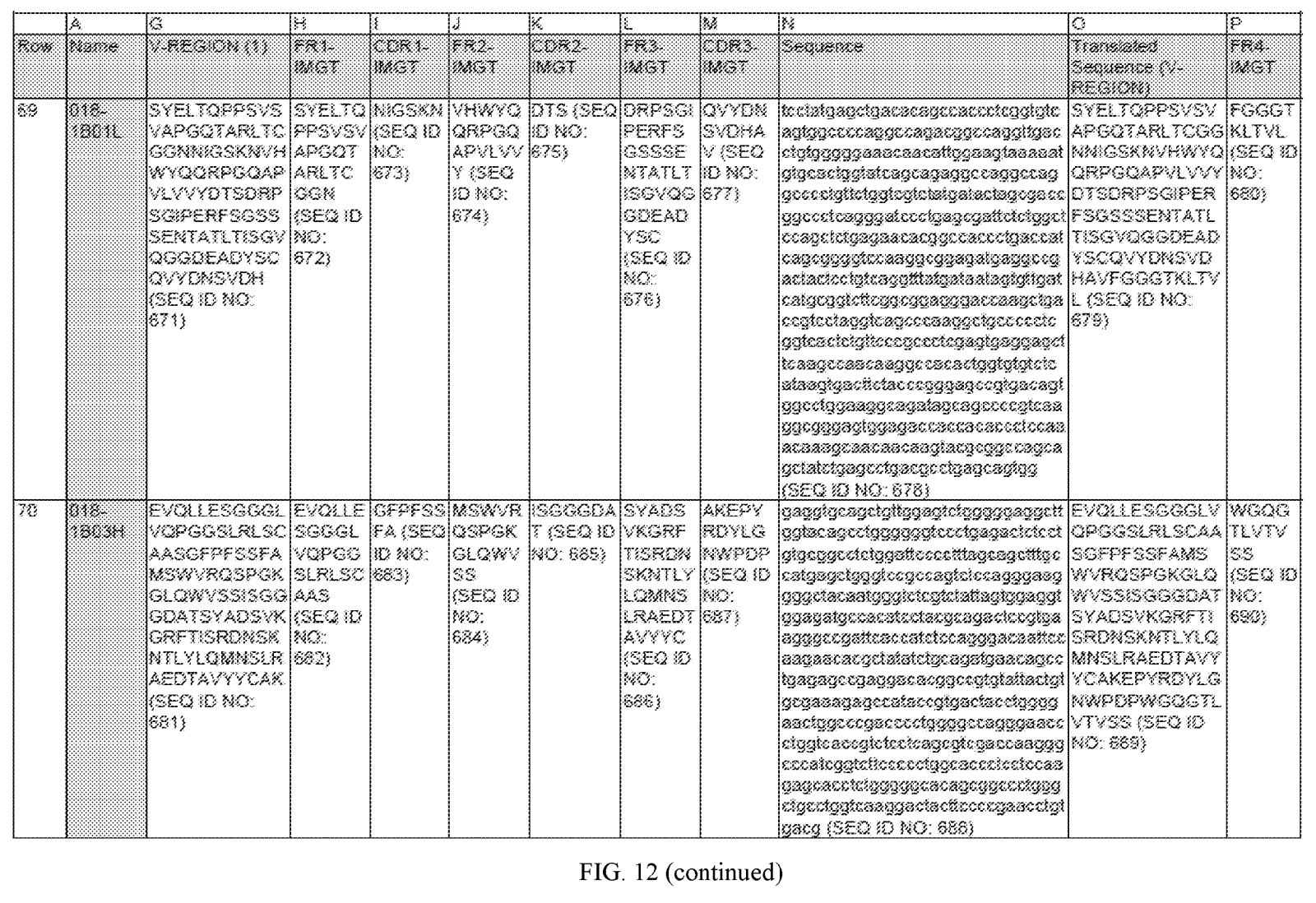
Figure 12:
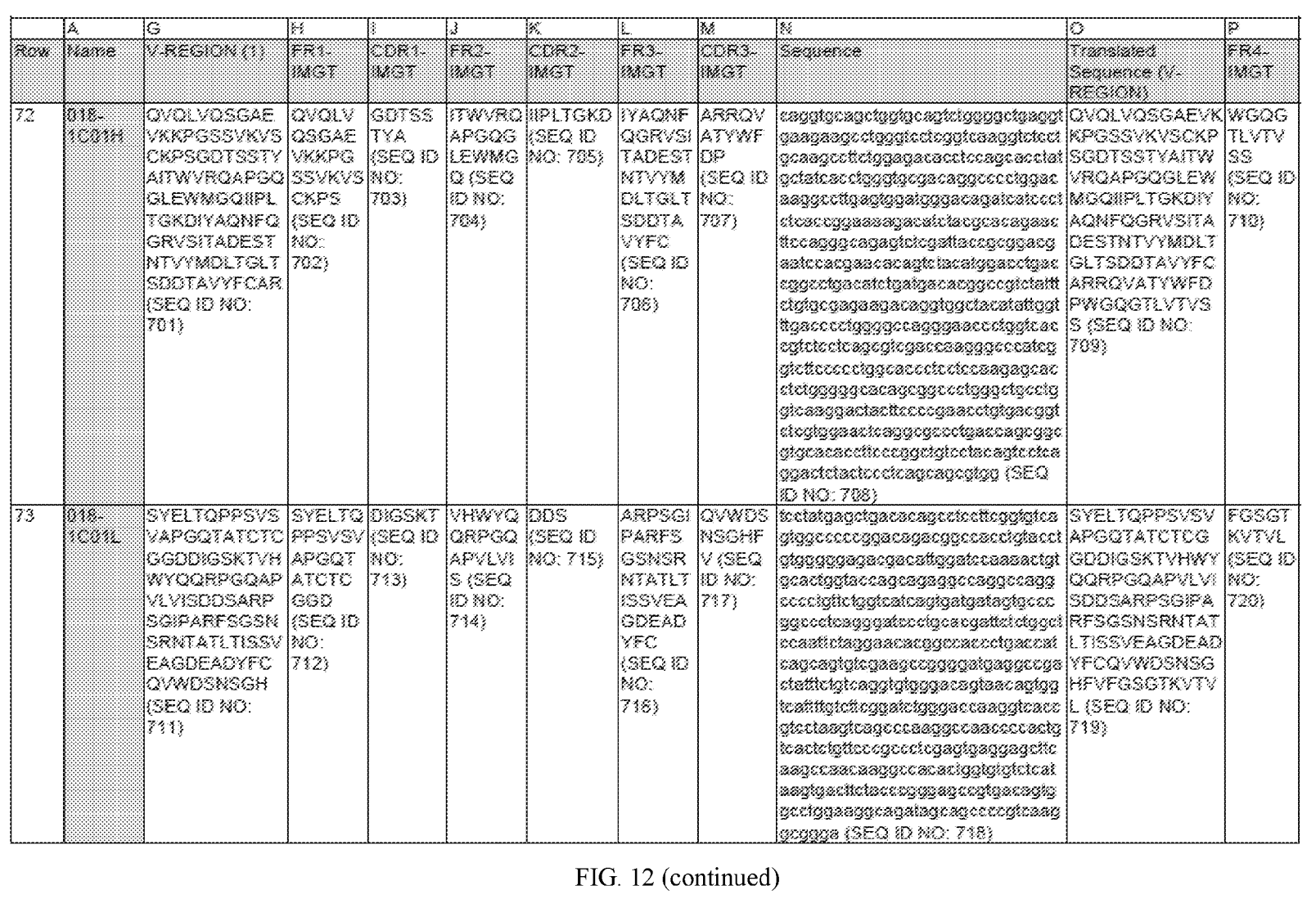
Figure 12:
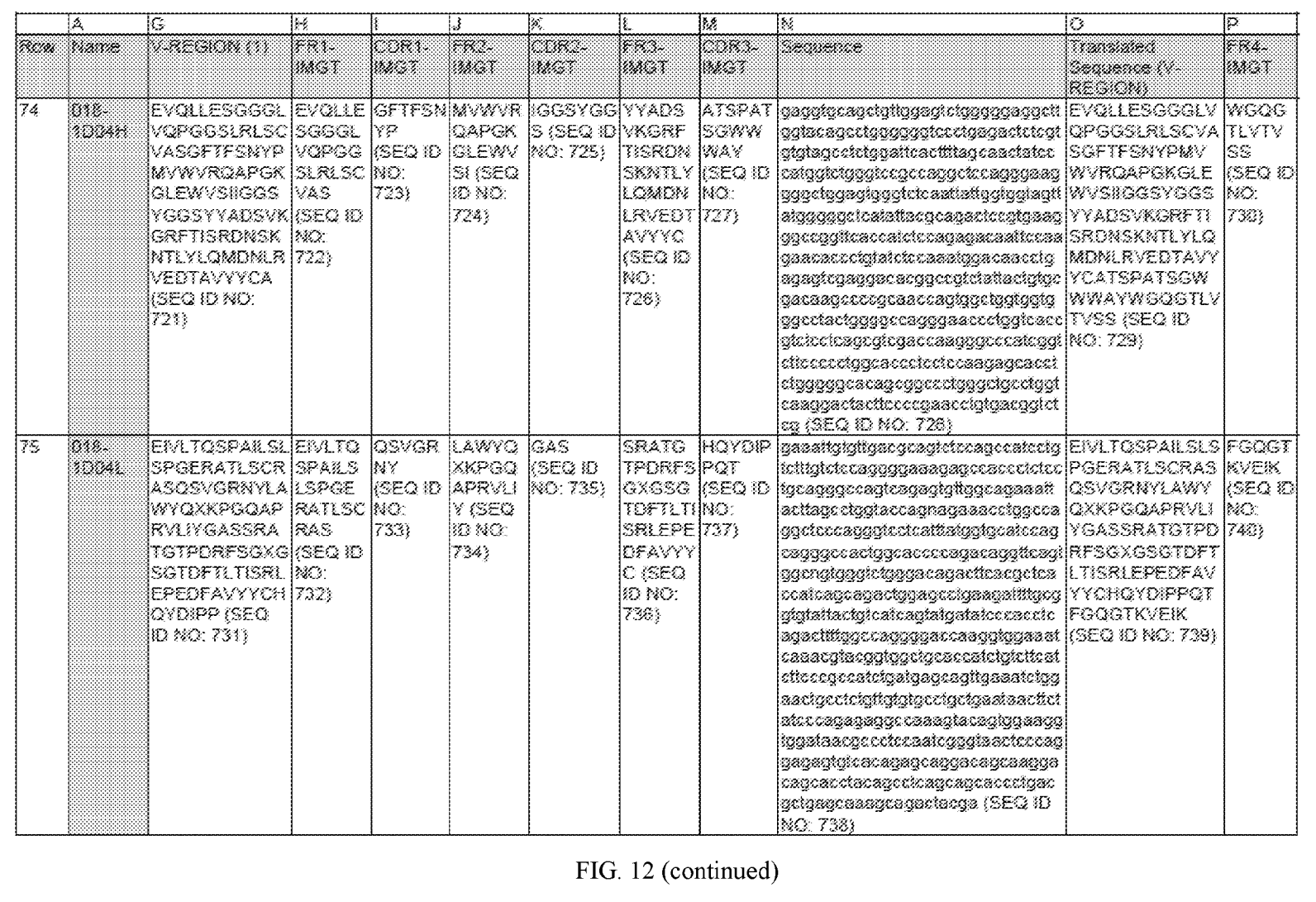
Figure 12:
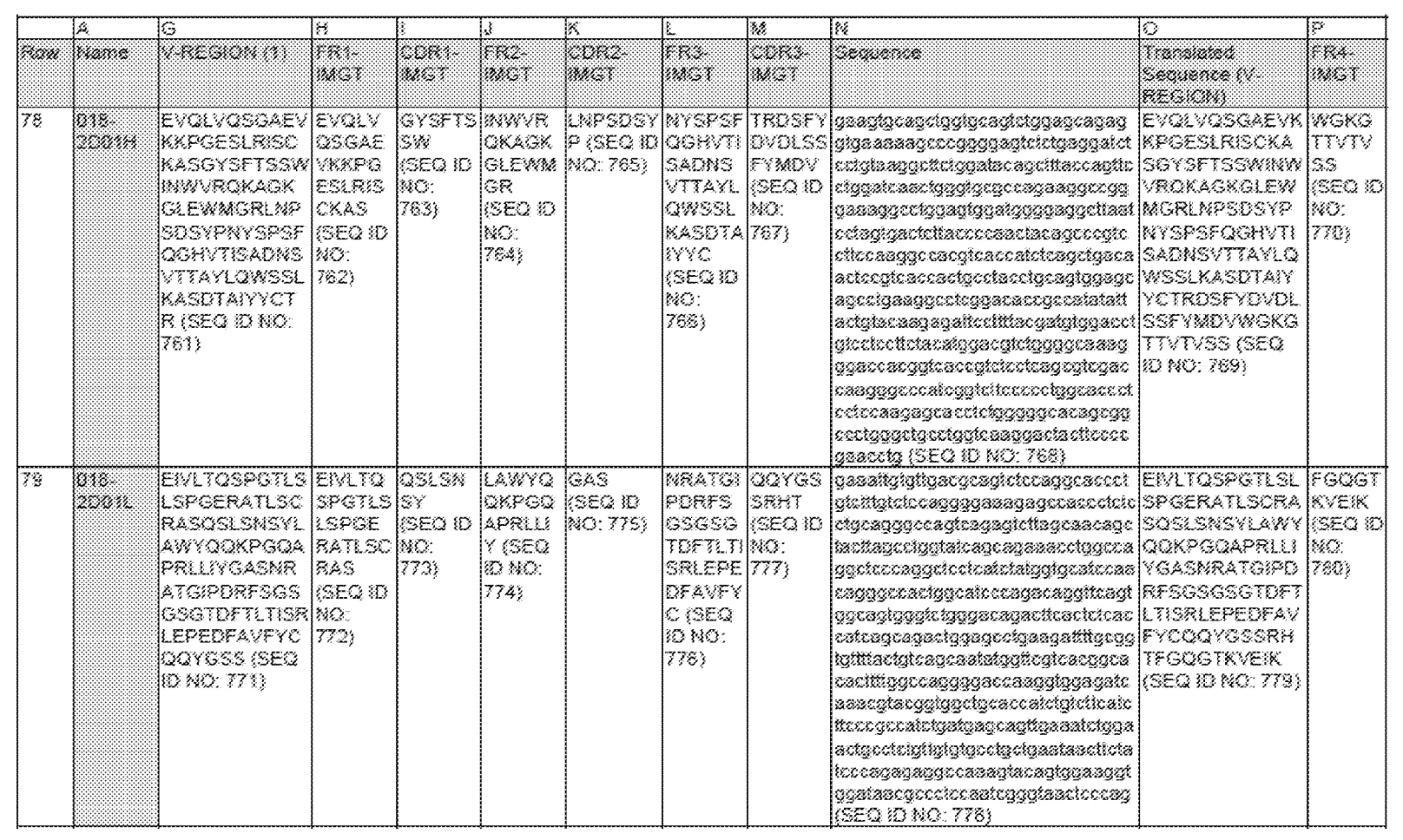
Figure 12:
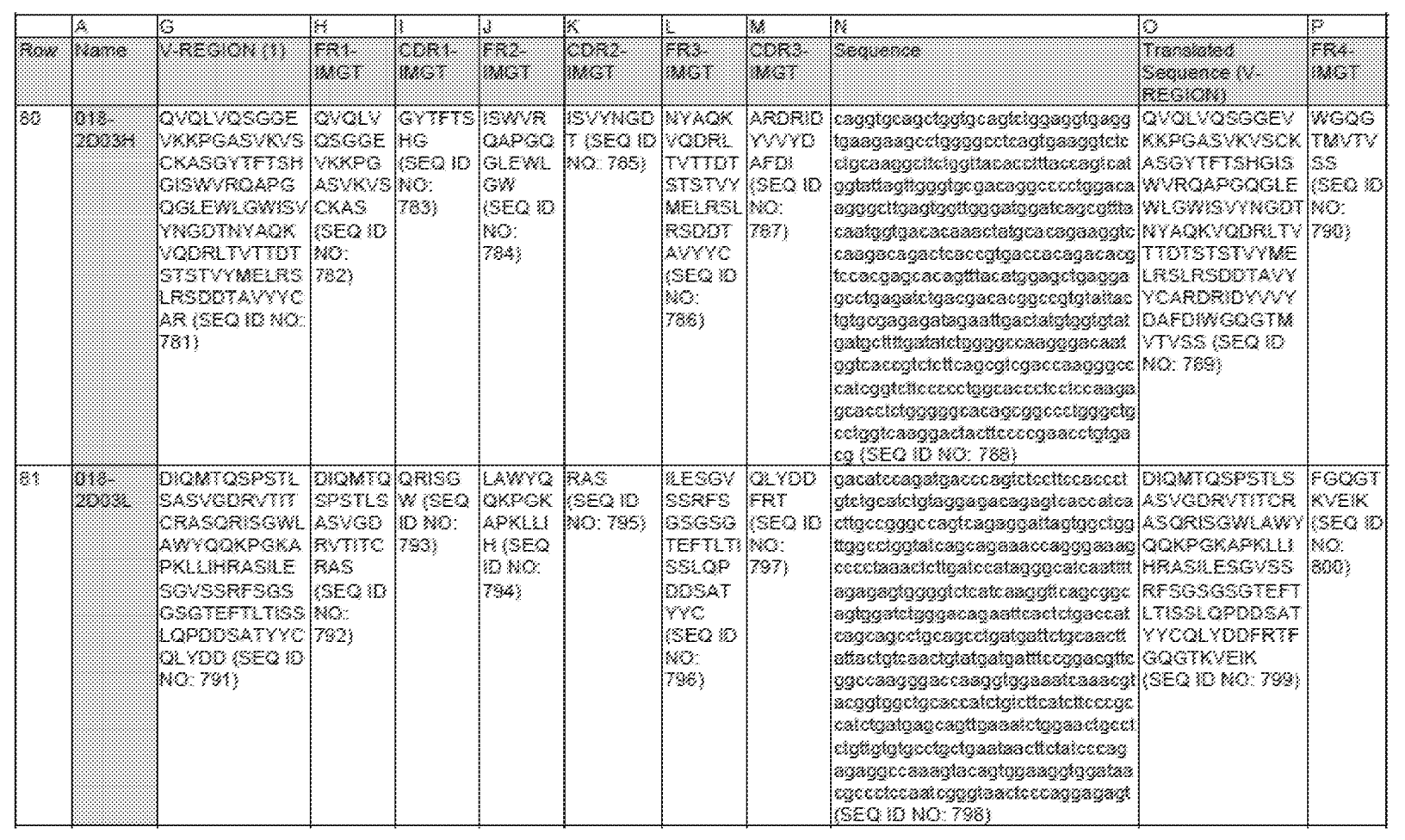
Figure 12:
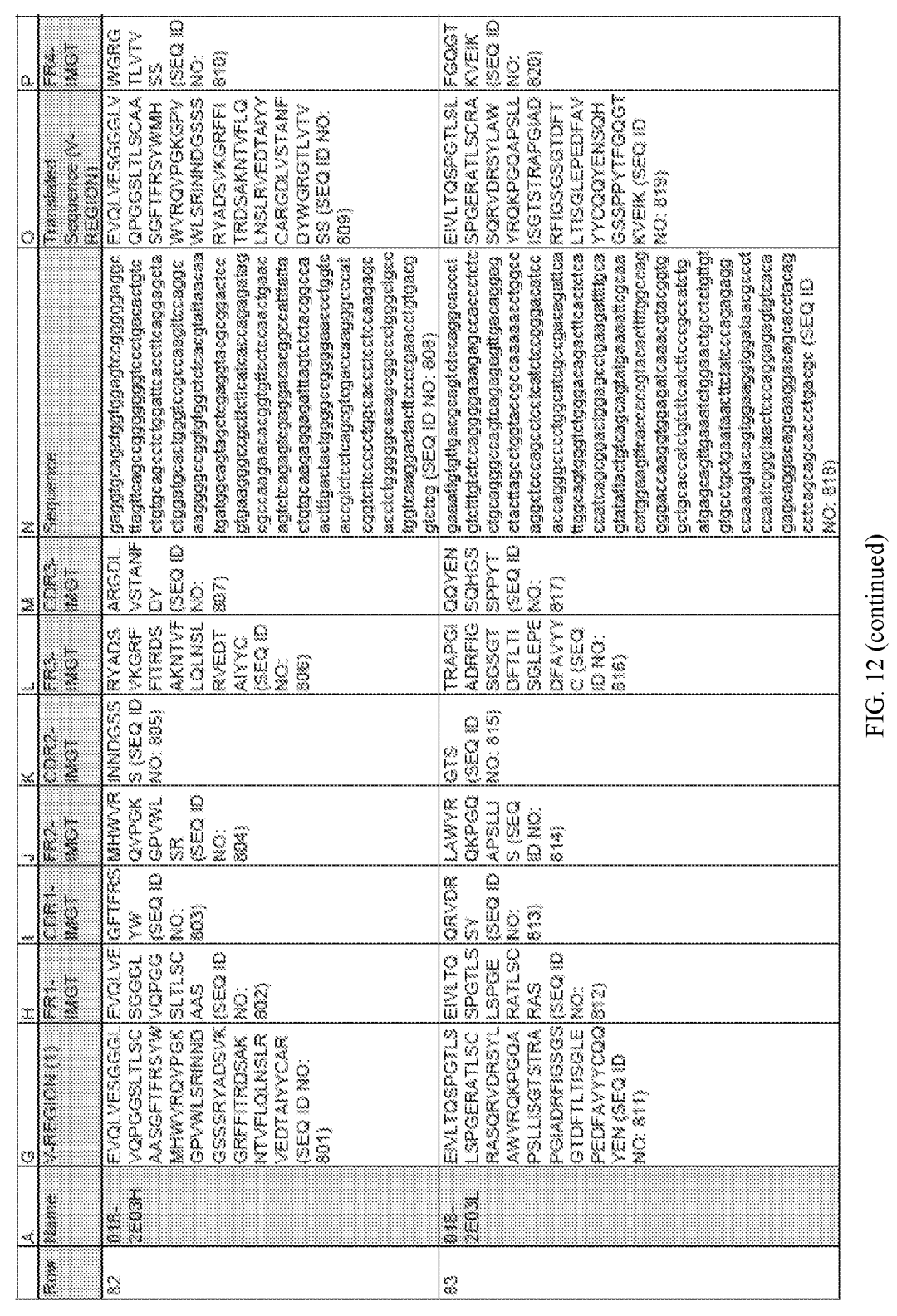
Figure 12:
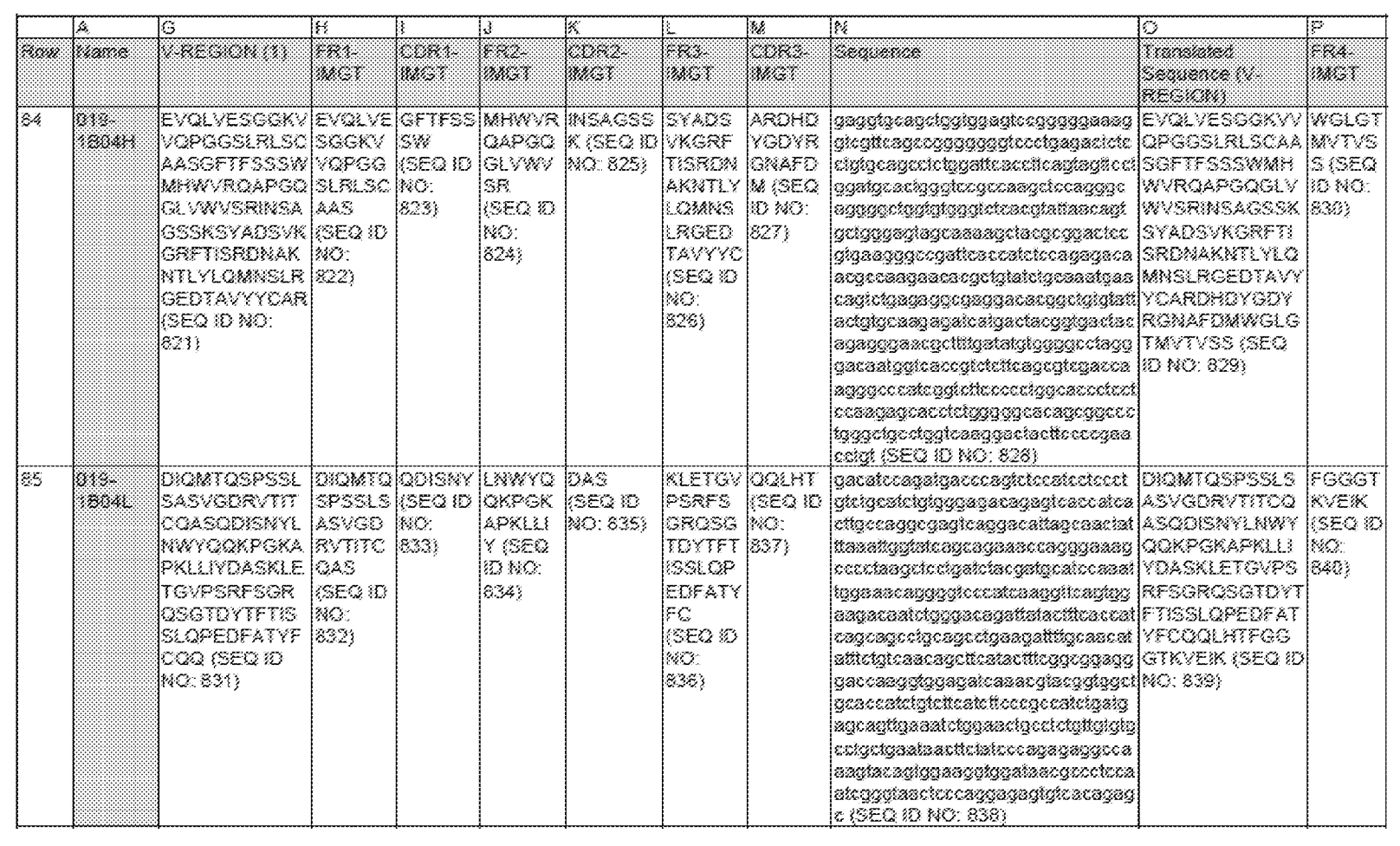
Figure 12:
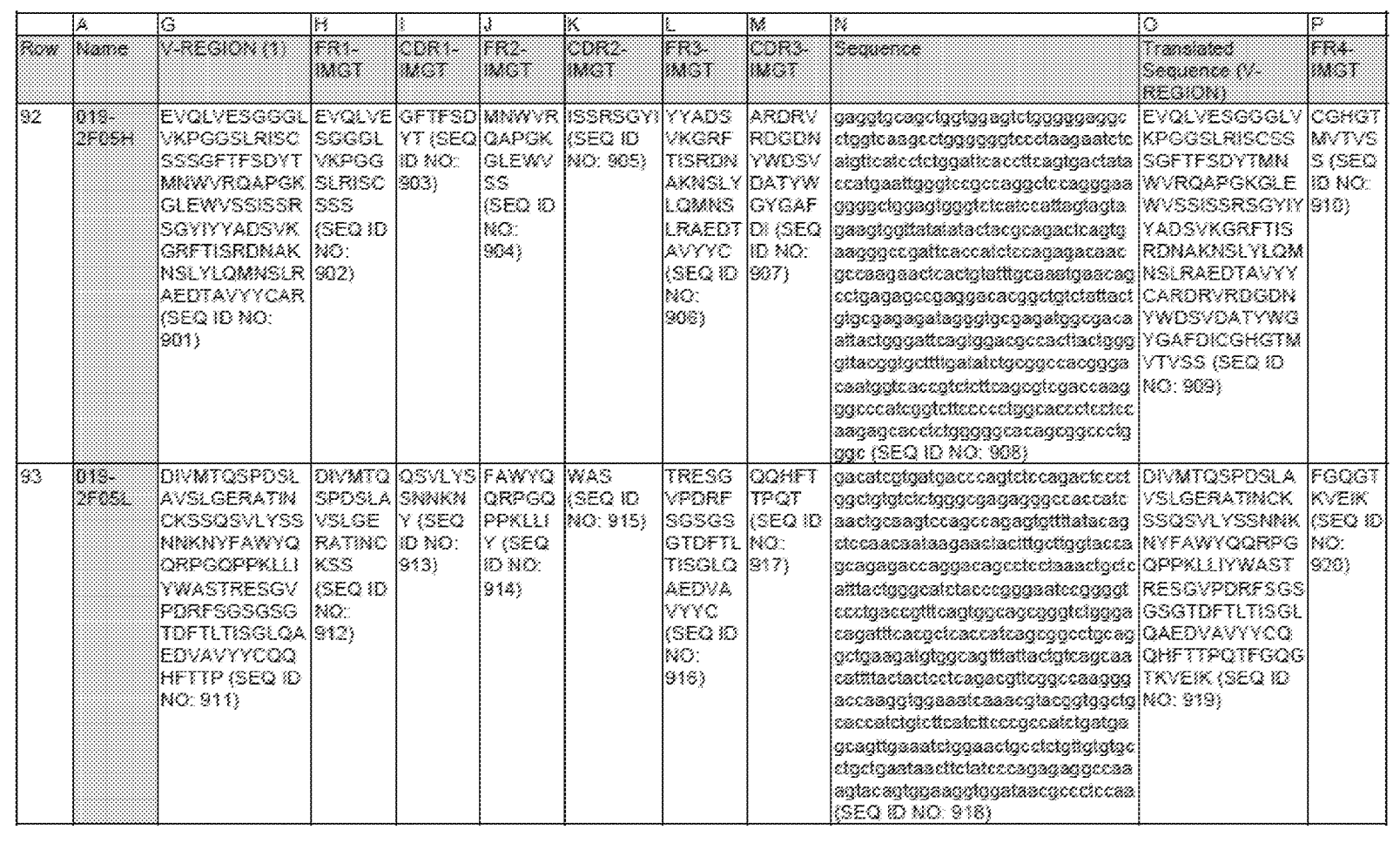
Figure 12:
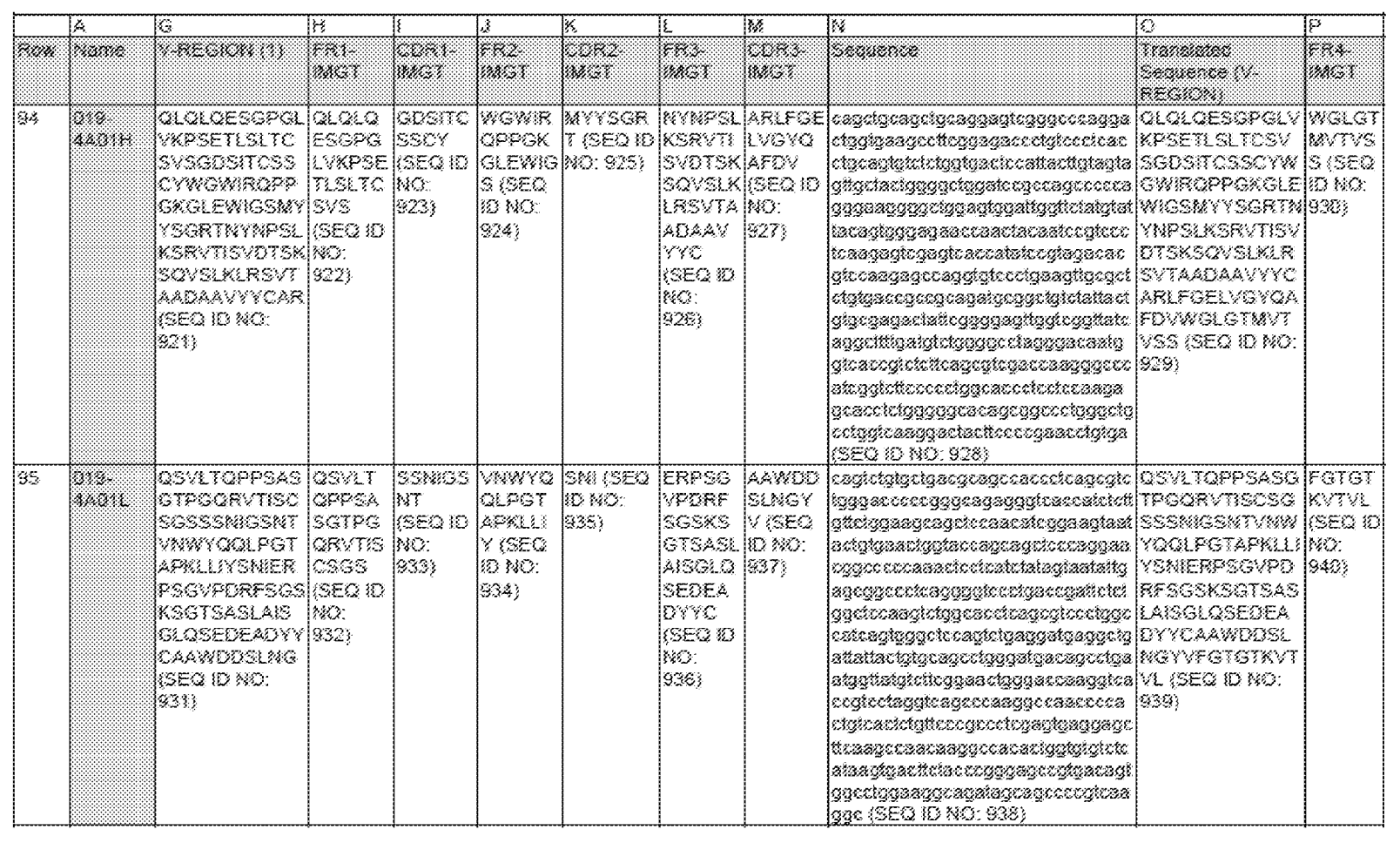
Figure 12:
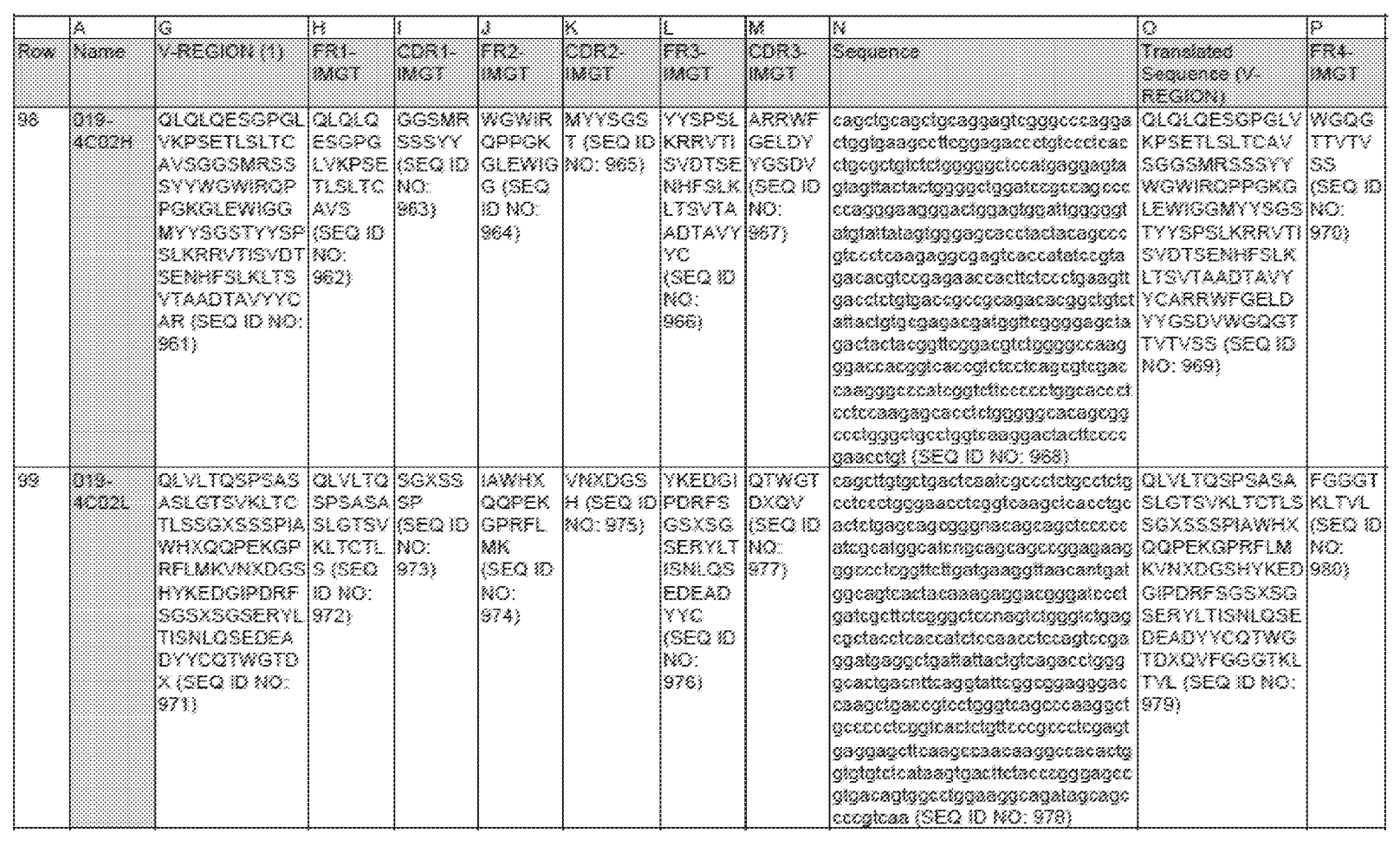
Figure 12:
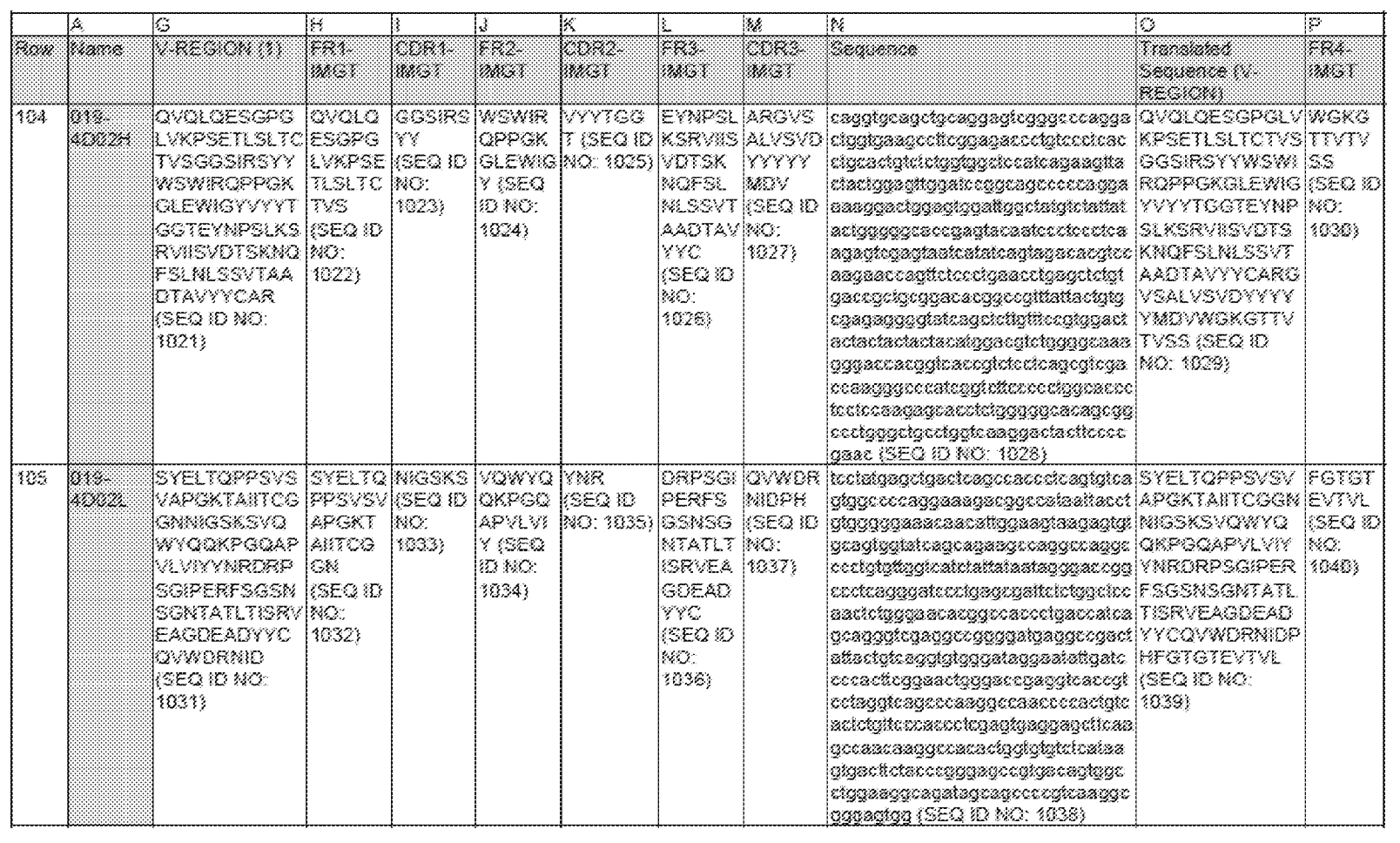
Figure 12:
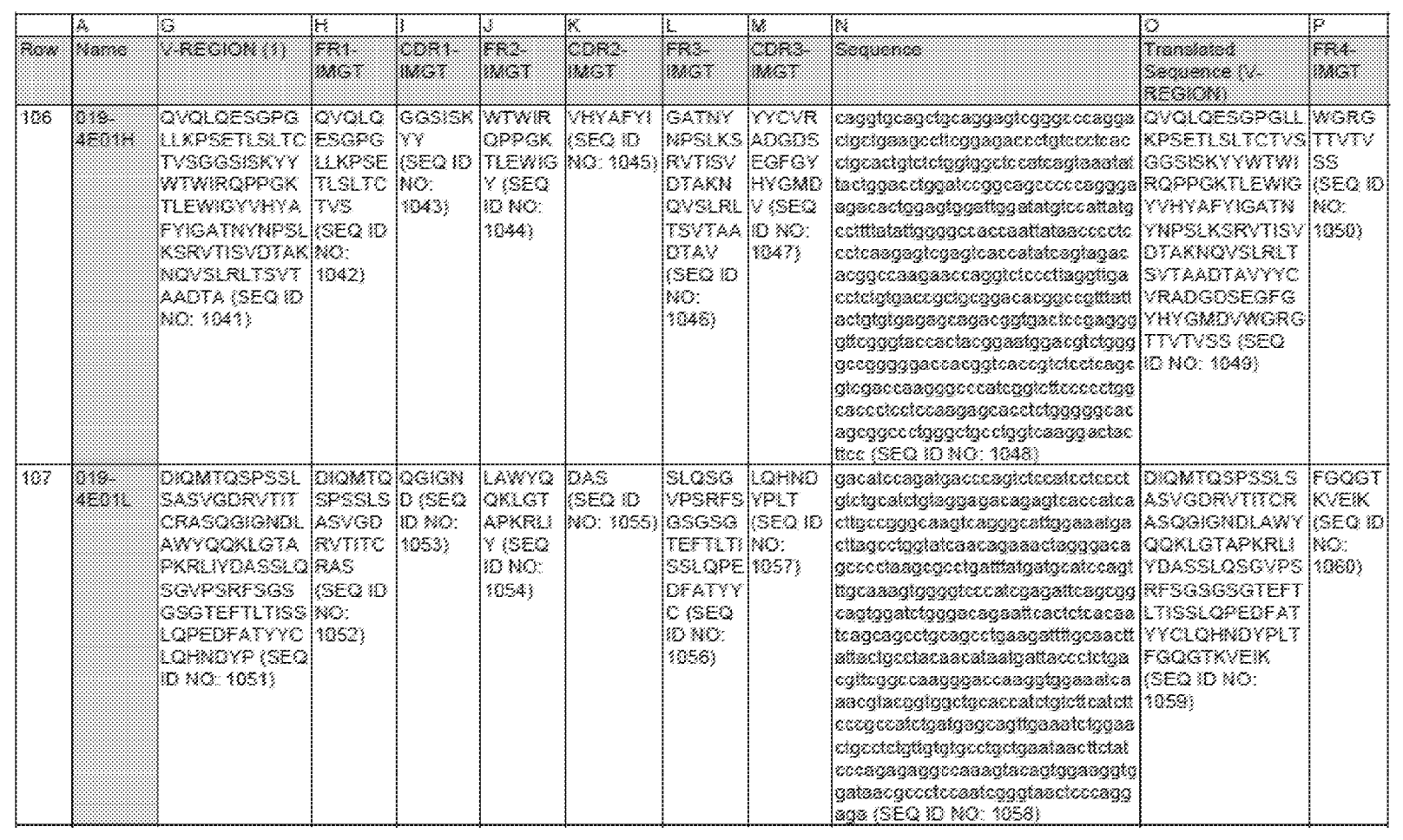
Figure 12:
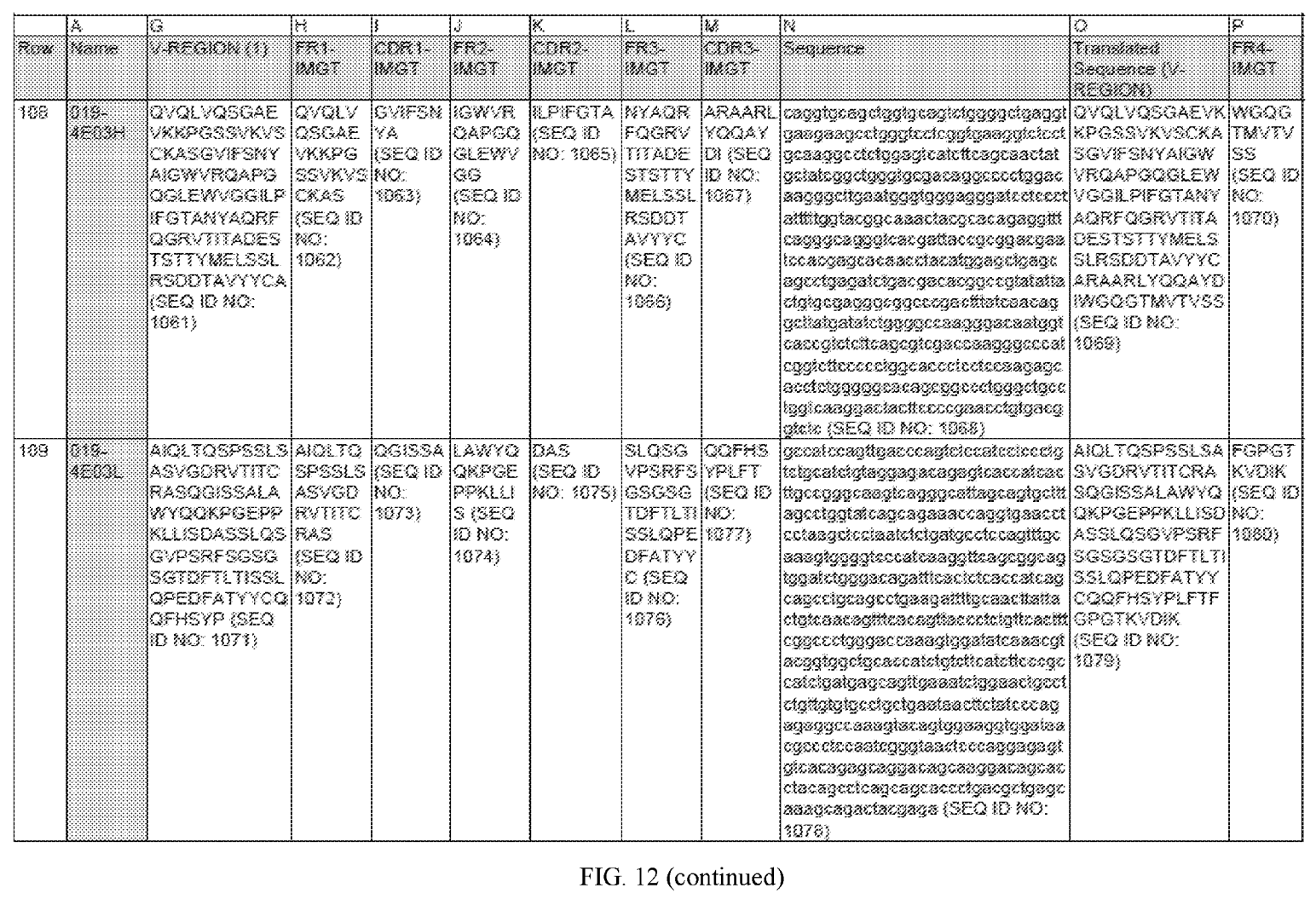
Figure 12:
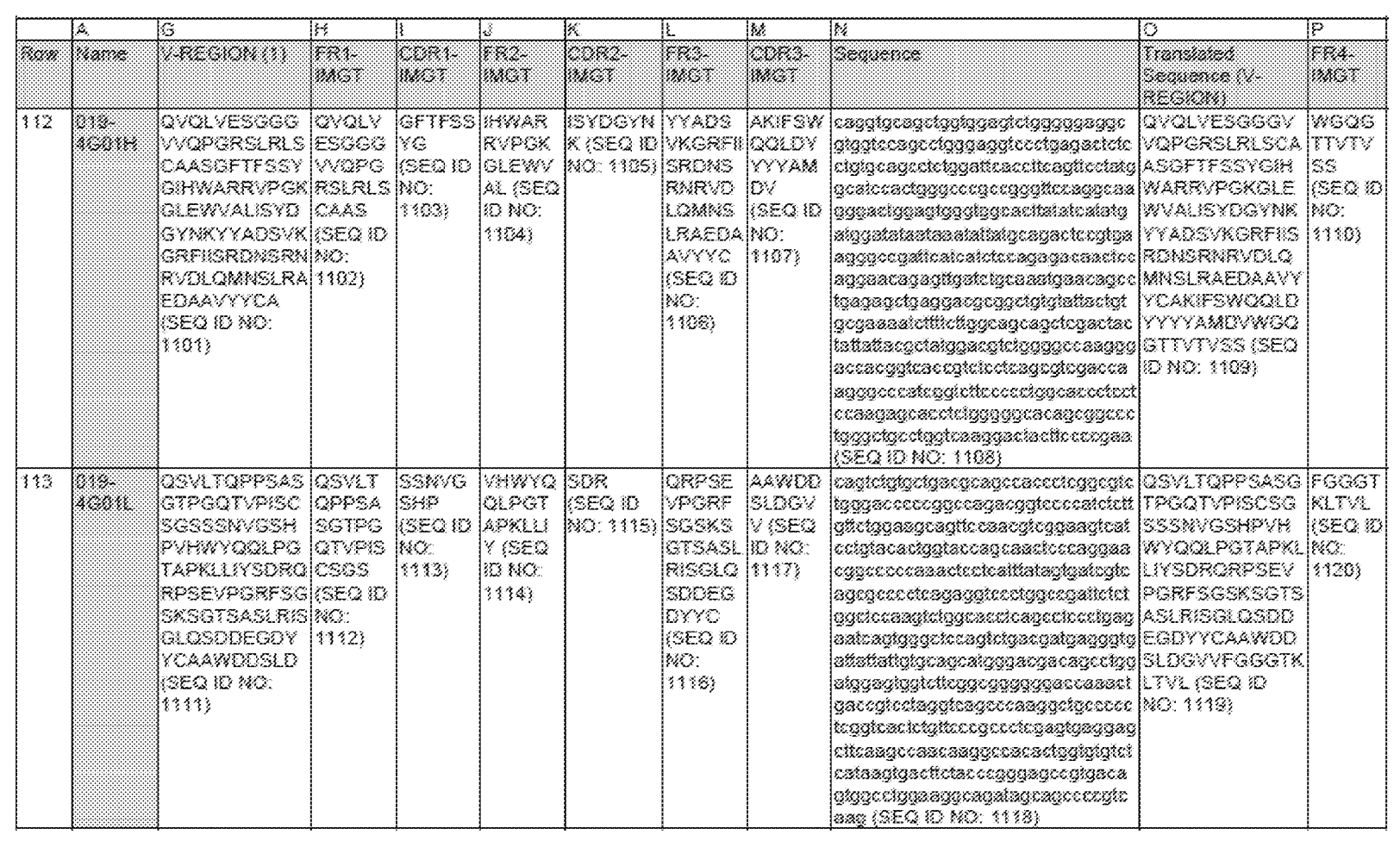
Figure 12:
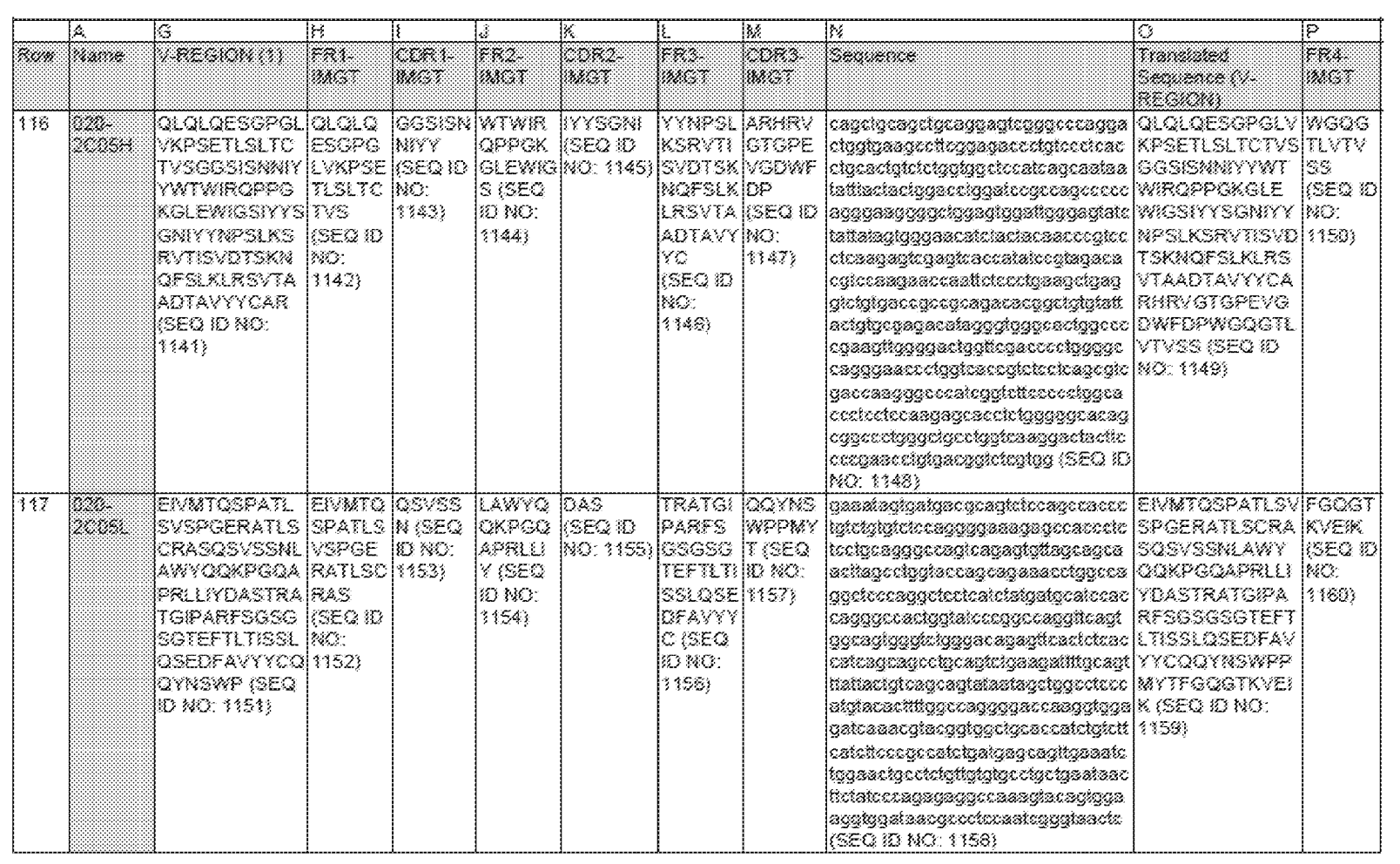
Figure 12:
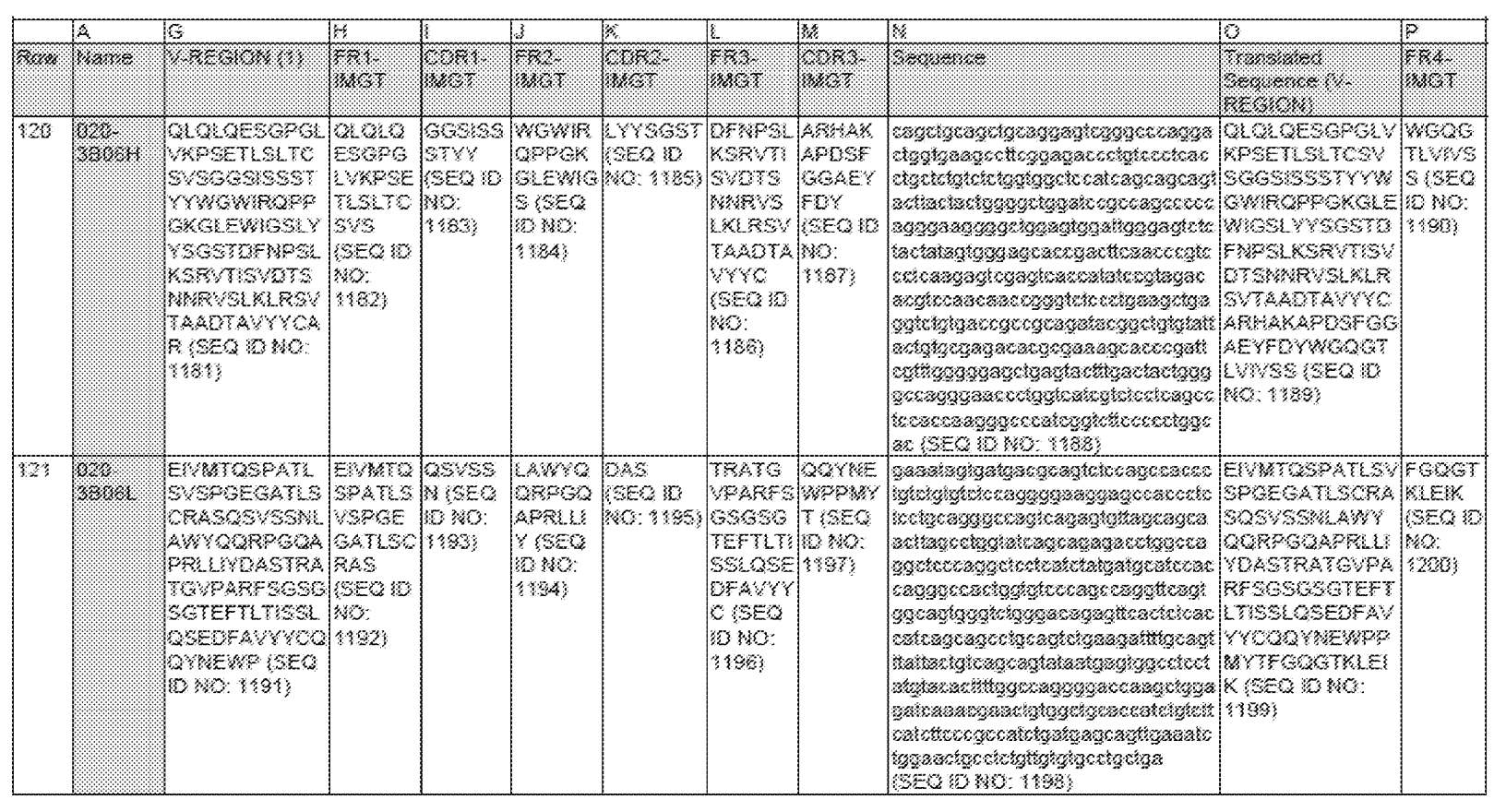
Figure 12:
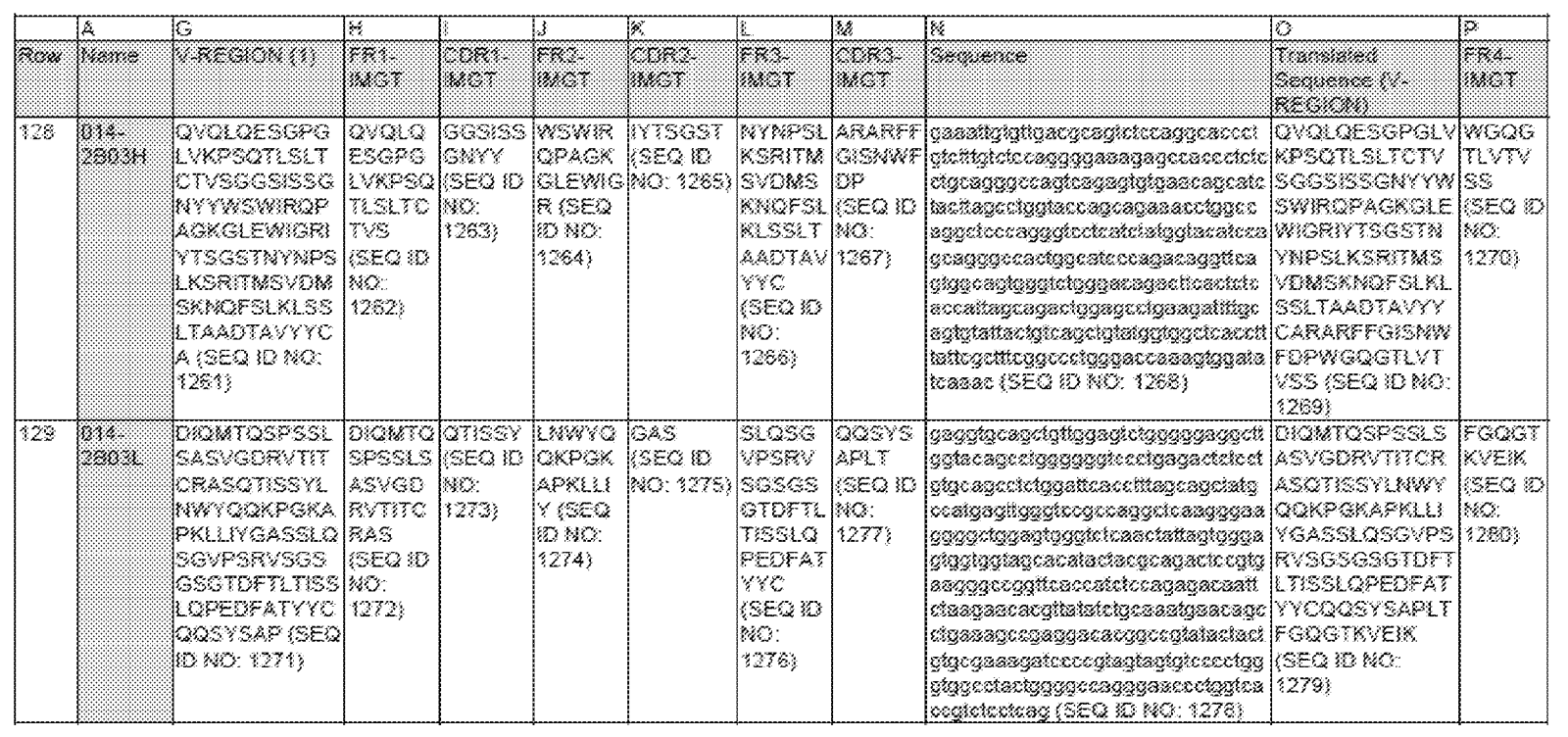
Figure 12:
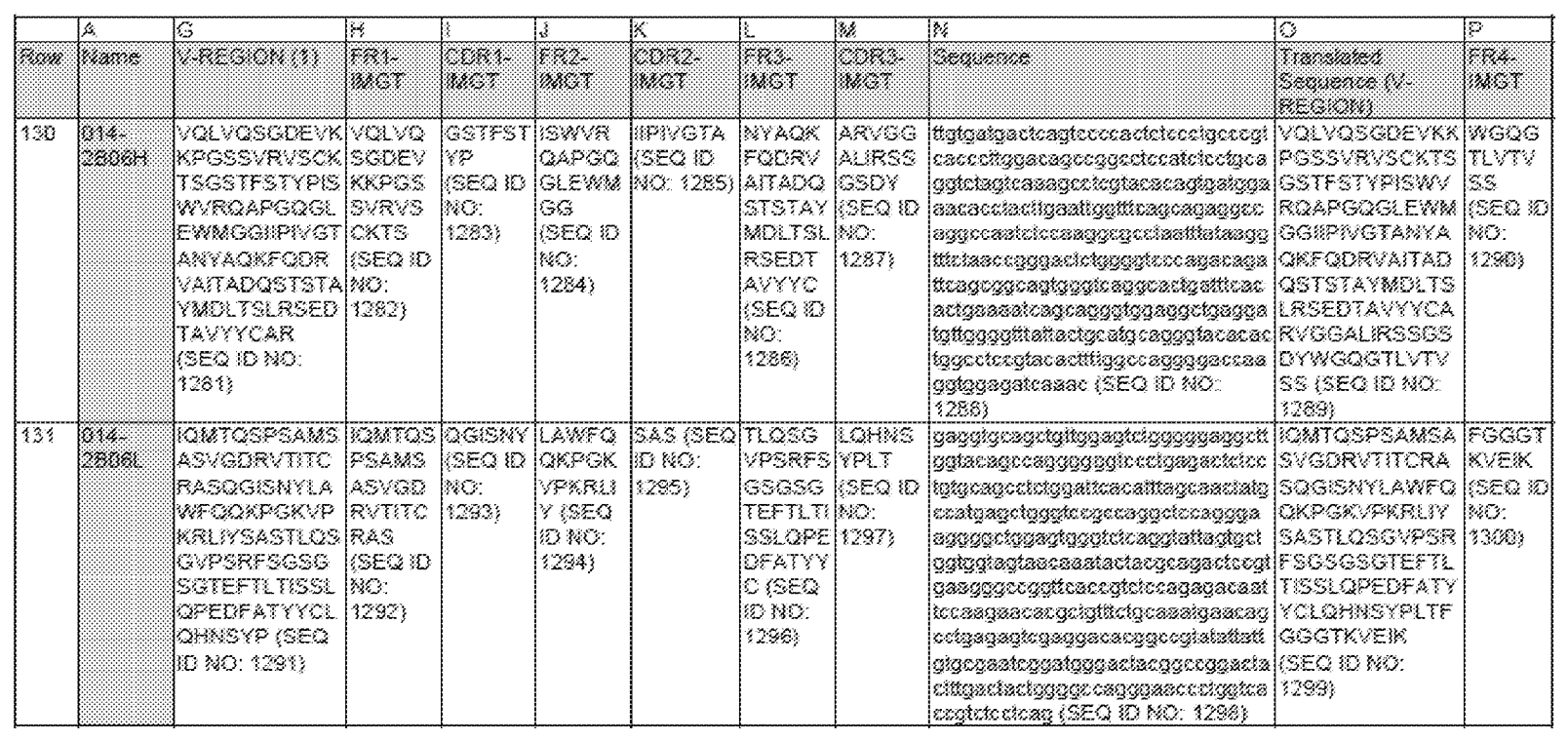
Figure 12:
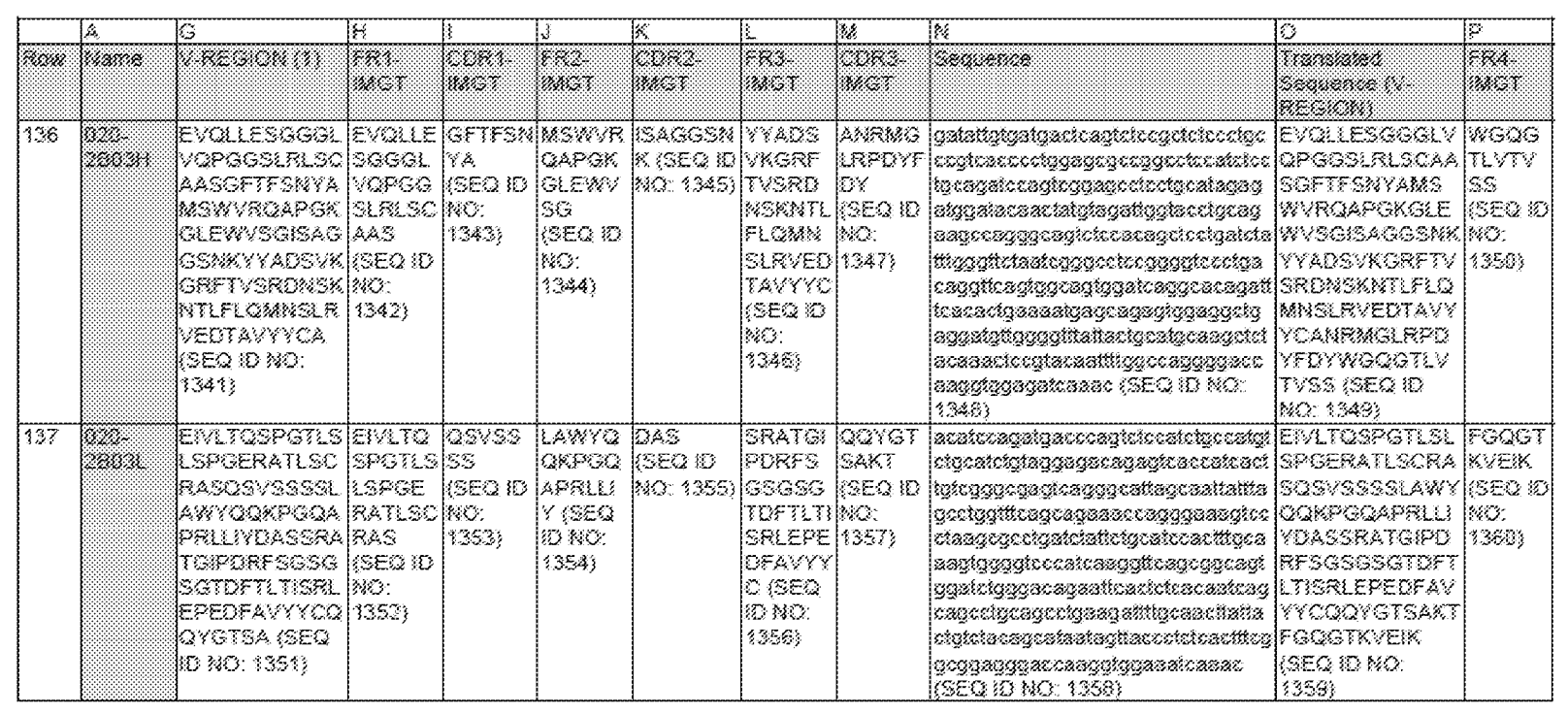
Figure 12:
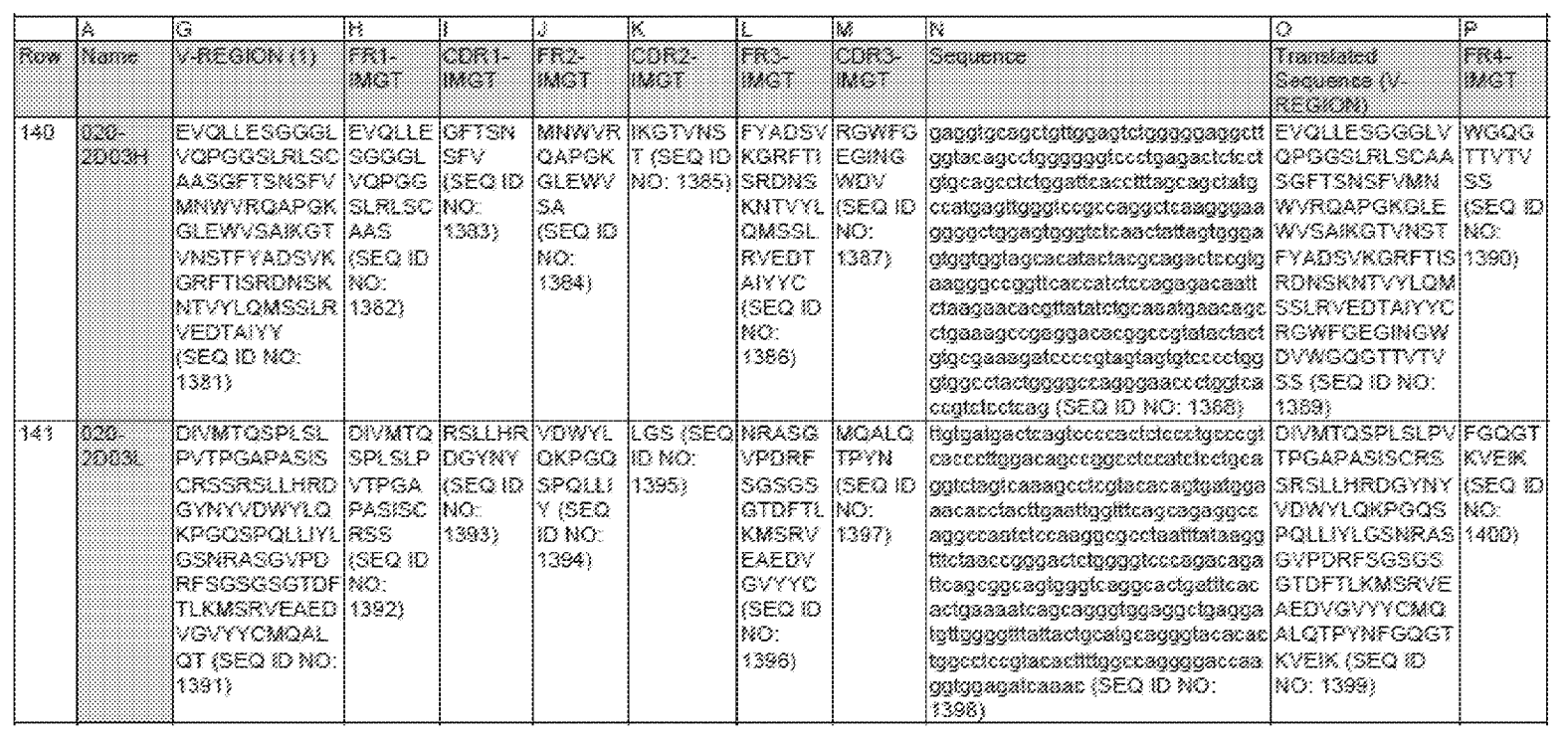

Disclosed herein are antibodies, antibody (antigen-binding) fragments wherein the antibody or the antibody fragment or the peptide binds to an HA domain of influenza (e.g., H1N1, H5N1, H3N2 or two or more of H1N1, H5N1 and H3N2) virus and comprises: (a) a $V_H$ CDR1 comprising or consisting of an amino acid sequence identical to or having 1, 2, or 3 amino acid residue substitutions or deletions relative to a $V_H$ CDR1 in column I of Table 1 (FIG. 12); (b) a $V_H$ CDR2 comprising or consisting of an amino acid sequence identical to or having 1, 2, or 3 amino acid residue substitutions or deletions relative to a $V_H$ CDR2 in column K of Table 1 (FIG. 12); (c) a $V_H$ CDR3 comprising or consisting of an amino acid sequence identical to or having 1, 2, or 3 amino acid residue substitutions or deletions relative to a $V_H$ CDR3 in column M of Table 1 (FIG. 12); (d) a $V_L$ CDR1 comprising or consisting of an amino acid sequence identical to or having 1, 2, or 3 amino acid residue substitutions or deletions relative to a $V_L$ CDR1 in column I of Table 1 (FIG. 12); (e) a $V_L$ CDR2 comprising or consisting of an amino acid sequence identical to or having 1, 2, or 3 amino acid residue substitutions or deletions relative to a $V_L$ CDR2 in column K of Table 1 (FIG. 12); and (f) a $V_L$ CDR3 comprising or consisting of an amino acid sequence identical to or having 1, 2, or 3 amino acid residue substitutions or deletions relative to a $V_L$ CDR3 in column M of Table 1 (FIG. 12). In certain embodiments the $V_H$ and VL CDRs are all from the same antibody in Table 1 (FIG. 12). In certain embodiments, the anti-influenza antibodies or antigen binding fragments comprise a $V_H$ CDR1 having an amino acid sequence identical to or comprising 1, 2, or 3 amino acid residue substitutions relative to a $V_H$ CDR1 in column I of Table 1 (FIG. 12), a $V_H$ CDR2 having an amino acid sequence identical to or comprising 1, 2, or 3 amino acid residue substitutions relative to a $V_H$ CDR2 in column K of Table 1 (FIG. 12) and a $V_H$ CDR3 having an amino acid sequence identical to or comprising 1, 2, or 3 amino acid residue substitutions relative to a $V_H$ CDR3 in column M of Table 1 (FIG. 12). In another embodiment, the anti-influenza antibodies comprise a $V_L$ CDR1 having an amino acid sequence identical to or comprising 1, 2, or 3 amino acid residue substitutions relative to a $V_L$ CDR1 in column I of Table 1 (FIG. 12), a $V_L$ CDR2 having an amino acid sequence identical to or comprising 1, 2, or 3 amino acid residue substitutions relative to a $V_L$ CDR2 in column K of Table 1 (FIG. 12), and a $V_L$ CDR3 having an amino acid sequence identical to or comprising 1, 2, or 3 amino acid residue substitutions relative to a $V_L$ CDR3 in column M of Table 1 (FIG. 12). In certain embodiments, the anti-influenza antibodies or antigen binding fragments thereof comprise a $V_H$ CDR1 having an amino acid sequence identical to a $V_H$ CDR1 in column I of Table 1 (FIG. 12), a $V_H$ CDR2 having an amino acid sequence identical to a $V_H$ CDR2 in column K of Table 1 (FIG. 12) and a $V_H$ CDR3 having an amino acid sequence identical to a $V_H$ CDR3 in column M of Table 1 (FIG. 12). In another embodiment, the anti-influenza antibodies comprise a $V_L$ CDR1 having an amino acid sequence identical to a $V_L$ CDR1 in column I of Table 1 (FIG. 12), a $V_L$ CDR2 having an amino acid sequence identical to a $V_L$ CDR2 in column K of Table 1 (FIG. 12); and a $V_L$ CDR3 having an amino acid sequence identical to a VL CDR3 in column M of Table 1 (FIG. 12). In certain embodiments the $V_H$ and $V_L$ CDRs are all from the same antibody in Table 1 (FIG. 12).

In some embodiments, the antibody or antibody (antigen binding) fragment comprises a CDR1, CDR2 and CDR3 ($V_H$ or $V_L$) having 1, 2, or 3 amino acid residue substitutions or deletions relative in Table 1 (FIG. 12) to a CDR1, CDR2 or CDR3 Table 1, wherein the substitutions are conservative. In some embodiments, a CDR contains 2, 3, 4, 5, 6, 7, 8, 9, 10, 11, 12, 13, 14, 15, 16, 17, 18 or 19 contiguous amino acids of a CDR depicted in Table 1. In certain embodiments, the anti-influenza antibodies comprise a heavy chain V-region having an amino acid sequence identical to or having 1, 2, 3, 4, 5, 6, 7, 8, 9 or 10 amino acid substitutions relative to a heavy chain V-region in column G or O of Table 1 (FIG. 12) and/or a light chain V-region having an amino acid sequence identical to or having 1, 2, 3, 4, 5, 6, 7, 8, 9 or 10 amino acid substitutions relative to a light chain V-region in column G or O of Table 1 (FIG. 12). In other embodiments, the antibody or antibody (antigen binding) fragment includes a deletion, such as a deletion of contiguous amino acids, such as at the amino or carboxy terminus.

In some embodiments, the isolated antibody or the antibody (antigen binding) fragment: (i) comprises a $V_H$ domain comprising three CDRs and a $V_L$ domain comprising three CDRs; and (ii) binds an HA domain of influenza virus (such as H1N1, H5N1 or both; or such as H1N1, H5N1, H3N2 or two or more of H1N1, H5N1 and H3N2) wherein the three CDRs of the $V_H$ domain comprise: (a) a $V_H$ CDR1 comprising the amino acid sequence of a $V_H$ CDR1 in column I of Table 1 (FIG. 12); (b) a $V_H$ CDR2 comprising the amino acid sequence of a $V_H$ CDR2 in column K of Table 1 (FIG. 12); and (c) a $V_H$ CDR3 comprising the amino acid sequence of a $V_H$ CDR3 in column M of Table 1 (FIG. 12). In additional embodiments, the isolated antibody or antibody (antigen binding) fragment: (i) comprises a $V_H$ chain domain comprising three CDRs and a $V_L$ chain domain comprising three CDRs; and (ii) binds an HA domain of influenza virus (e.g., H1N1, H5N1 or both) wherein the three CDRs of the $V_L$ chain domain comprise: (a) a $V_L$ CDR1 comprising the amino acid sequence of $V_L$ CDR1 in column I of Table 1 (FIG. 12); (b) a $V_L$ CDR2 comprising the amino acid sequence of a $V_L$ CDR2 in column K of Table 1 (FIG. 12); and (c) a $V_L$ CDR3 comprising the amino acid sequence of a $V_L$ CDR3 in column M of Table 1 (FIG. 12). In certain embodiments the $V_H$ and $V_L$ CDRs are all from the same antibody in Table 1 (FIG. 12).

An antibody or antibody (antigen binding) fragment can optionally comprise: (a) a $V_H$ FR1 having the amino acid sequence of a $V_H$ FR1 shown in Table 1 (FIG. 12) (b) a $V_H$ FR2 having the amino acid sequence of a $V_H$ FR2 shown in Table 1 (FIG. 12); (c) a $V_H$ FR3 having the amino acid sequence of a $V_H$ FR3 shown in Table 1 (FIG. 12); (d) a $V_H$ FR4 having the amino acid sequence of a $V_H$ FR4 shown in Table 1 (FIG. 12); (e) a $V_L$ FR1 having the amino acid sequence of $V_L$ FR1 shown in Table 1 (FIG. 12)1; (f) a $V_L$ FR2 having the amino acid sequence of a $V_L$ FR2 shown in Table 1 (FIG. 12); (g) a $V_L$ FR3 having the amino acid sequence of a $V_L$ FR3 shown in Table 1 (FIG. 12); and (h) a $V_L$ FR4 having the amino acid sequence of a $V_L$ FR4 in shown in Table 1 (FIG. 12).

In additional embodiments an antibody or antibody (antigen binding) fragment is disclosed, wherein the antibody or the fragment binds HA of an influenza A virus (e.g., H1N1, H5N1 or two of more of H1N1, H5N1 and H3N2) and comprises a heavy chain variable domain having an amino acid sequence identical to or comprising up to 10 (e.g., up to 9, 8, 7, 6, 5, 4, 3, 2 or 1) amino acid residue substitutions relative to the amino acid sequence of the heavy chain variable domain (column G or O) of a selected antibody in Table 1 (FIG. 12) and comprises a light chain variable domain having an amino acid sequence identical to or comprising up to 10 (e.g., up to 9, 8, 7, 6, 5, 4, 3, 2 or 1) amino acid residue substitutions relative to the amino acid sequence of the light chain variable domain (column G or O) of the selected antibody in Table 1 (FIG. 12). In certain embodiments the heavy chain variable domain and the light chain variable domain are from the same antibody in Table 1 (FIG. 12). In additional embodiments, disclosed is a purified antibody or antibody (antigen binding) fragment, wherein the antibody or the fragment binds HA of influenza virus (e.g., H1N1, H5N1 or two of more of H1N1, H5N1 and H3N2) and comprises a heavy chain variable domain having at least 90% or 95% identity to the amino acid sequence of the heavy chain variable domain (column G or O) of a selected antibody in Table 1 (FIG. 12) and comprises a light chain variable domain having at least 90% or 95% identity to the amino acid sequence of the light chain variable domain (column G or O) of the selected antibody in Table 1 (FIG. 12). In certain embodiments the heavy chain variable domain and the light chain variable domain are from the same antibody in Table 1 (FIG. 12). In some examples, the antibody or antibody (antigen binding) fragment binds HA of influenza virus (e.g., H1N1, H5N1 two of more of H1N1, H5N1 and H3N2) and includes a heavy chain variable domain having the amino acid sequence of the heavy chain variable domain sequence (column G or O) of a selected antibody in Table 1 (FIG. 12) and the light chain variable domain having the amino acid sequence of the light chain variable domain sequence (column G or O, respectively) of the selected antibody in Table 1 (FIG. 12).

In yet other embodiments, disclosed is a purified antibody or antibody (antigen binding) fragment, wherein the antibody or the fragment binds the same epitope on HA of influenza virus (e.g., H1N1, H5N1 or two of more of H1N1, H5N1 and H3N2) as that bound by an antibody comprising: (a) a heavy chain variable domain having the amino acid sequence of the heavy chain variable domain sequence (column G) of a selected antibody in Table 1 (FIG. 12); and (b) a light chain variable domain having the amino acid sequence of the light chain variable domain sequence (column G) of the selected antibody in Table 1 (FIG. 12).

In yet other embodiments, disclosed is a purified antibody or antibody (antigen binding) fragment, wherein the antibody or the fragment binds to an HA domain of influenza virus (e.g., H1N1, H5N1 or both), comprising: (a) a polypeptide comprising an amino acid sequence identical to or having 1, 2, 3, 4, 5, 6, 7, 8, 9 or 10 amino acid substitutions, or having up to 5 amino acid substitutions, as compared to a V-D-J sequence (FIG. 14); and (a) a polypeptide comprising an amino acid sequence identical to, identical to or having 1, 2, 3, 4, 5, 6, 7, 8, 9 or 10 amino acid substitutions, or having up to 5 amino acid substitutions compared to a V-J sequence (FIG. 14). In certain embodiments, the anti-influenza antibodies comprise a heavy chain VDT-region having an amino acid sequence identical to a heavy chain VDJ-region in column F of Table 1 (FIG. 12) and a light chain VJ-region identical to a light chain VJ-region in column G of Table 1 (FIG. 12). In certain embodiments, the anti-influenza antibodies comprise a heavy chain V-region having an amino acid sequence identical to a heavy chain V-region in column G of Table 1 (FIG. 12) and a light chain V-region identical to a light chain V-region in column G of Table 1 (FIG. 12).

In one embodiment, the anti-influenza antibodies bind HA of an H1N1 influenza virus, or an antigenic fragment thereof, wherein the antibody has at least 60%, 65%, 70%, 75%, 80%, 85%, 90%, 95% or 100% identity to the amino acid sequence of an antibody disclosed herein. In a further embodiment, the anti-influenza antibodies bind to HA of an H1N1 influenza virus, or an antigenic fragment thereof, wherein the antibody has at least 90%, 91%, 92%, 93%, 94%, 95%, 96%, 97%, 98%, 99% or 100% identity to the amino acid sequence of an antibody described herein. In other embodiments, an anti-influenza antibody binds HA of an H1N1 influenza virus and an H5N1 influenza virus, or an antigenic fragment thereof, wherein the antibody has at least 60%, 65%, 70%, 75%, 80%, 85%, 90%, 95% or 100% identity to the amino acid sequence of an antibody disclosed herein. In further embodiments, the anti-influenza antibodies bind to HA of an H1N1 influenza virus polypeptide and an H5N1 influenza virus polypeptide, or an antigenic fragment thereof, wherein the antibody has at least 90%, 91%, 92%, 93%, 94%, 95%, 96%, 97%, 98%, 99% or 100% identity to the amino acid sequence of an antibody disclosed herein. In yet other embodiments the an anti-influenza antibody binds HA of an H1N1 influenza virus, an H5N1 influenza virus, and an H3N2 influenza virus, or an antigenic fragment thereof, wherein the antibody has at least 60%, 65%, 70%, 75%, 80%, 85%, 90%, 95% or 100% identity to the amino acid sequence of an antibody disclosed herein. In further embodiments, the anti-influenza antibodies bind to HA of an H1N1 influenza virus polypeptide, an H5N1 influenza virus polypeptide and an H3N2 influenza virus polypeptide, or an antigenic fragment thereof, wherein the antibody has at least 90%, 91%, 92%, 93%, 94%, 95%, 96%, 97%, 98%, 99% or having at least 100% identity to the amino acid sequence of an antibody disclosed herein.

Conservative variants of the antibodies can be produced. Such conservative variants employed in antibody fragments, such as dsFv fragments or in scFv fragments, will retain critical amino acid residues necessary for correct folding and stabilizing between the $V_H$ and the $V_L$ regions, and will retain the charge characteristics of the residues in order to preserve the low pI and low toxicity of the molecules. Amino acid substitutions (such as at most one, at most two, at most three, at most four, or at most five amino acid substitutions) can be made in the $V_H$ and the $V_L$ regions to increase yield. In particular examples, the $V_H$ sequence and/or $V_L$ sequence is shown in FIG. 12. Conservative amino acid substitution tables providing functionally similar amino acids are well known to one of ordinary skill in the art. The following six groups are examples of amino acids that are considered to be conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

In further embodiments, the antibody, antibody fragment or peptide comprises a heavy chain and/or light chain CDRs of an antibody selected from: 05-2G02, 09-2A06 and 09-3A01.

In some embodiments the antibody, antibody (antigen binding) fragment or peptide comprises:

a) a CDR1 comprising at least 7 contiguous amino acids of GYTFSNYG (SEQ ID NO: 3); a CDR2 comprising at least 7 contiguous amino acids of ISAYNGHT (SEQ ID NO: 5); and a CDR3 comprising at least 14 or 15 contiguous amino acids of ARDRRDLLTGSLGDY (SEQ ID NO: 7;

b) a CDR1 comprising GYTFSNYG (SEQ ID NO: 3); a CDR2 comprising ISAYNGHT (SEQ ID NO: 5); and a CDR3 comprising ARDRRDLLTGSLGDY (SEQ ID NO: 7);

c) a heavy chain variable domain comprising: a CDR1 comprising or consisting of GYTFSNYG (SEQ ID NO: 3); a CDR2 comprising or consisting of ISAYNGHT (SEQ ID NO:

5); and a CDR3 comprising or consisting of ARDRRDLLTGSLGDY (SEQ ID NO: 7);

d) a heavy chain variable domain comprising: QVQLVQS-GPEVKKPGASIKVSCRAS GYTFSNYGITWVRQAPGQGLEWMGWISAYNGHTN SAQKFQGRVTMTTDTSTSTAYMEVRSL-RSDDTAVYYCAR (SEQ ID NO: 1) or comprising the 05-2G02 heavy chain variable domain sequence provided in column O of FIG. 12;

e) a CDR1 comprising at least 5 contiguous amino acids of RGLLYIDGNTY (SEQ ID NO: 13); a CDR2 comprising at least 2 contiguous amino acids of NVS (SEQ ID NO: 15); and a CDR3 comprising at least 8 contiguous amino acids of MQGTYWPFT (SEQ ID NO: 17);

f) a CDR1 comprising or consisting of RGLLYIDGNTY (SEQ ID NO: 13); a CDR2 comprising or consisting of NVS (SEQ ID NO: 15); and a CDR3 comprising MQGTYWPFT (SEQ ID NO: 17);

g) a light chain variable domain comprising: a CDR1 comprising or consisting of RGLLYIDGNTY (SEQ ID NO: 13); a CDR2 comprising or consisting of NVS (SEQ ID NO: 15); and a CDR3 comprising or consisting of MQGTYWPFT (SEQ ID NO: 17);

h) a light chain variable domain comprising: DVVMTQS-PLSLPVTLGQPASISCRSS RGLLYIDGNTYLNWFQQRPGQSPRRLIHNVSNRDSG VPDRFSGSGSRTDFTLKISRVEAEDVGVYYC MQGTYW (SEQ ID NO: 11) or comprising the 05-2G02 light chain variable domain sequence provided in O of Column FIG. 12.

In some embodiments the antibody (09-2A06), antibody fragment or peptide comprises:

a) a CDR1 comprising at least 8 contiguous amino acids of GGSFTSFV (SEQ ID NO: 23); a CDR2 comprising at least 7 contiguous amino acids of VIPIFATP (SEQ ID NO: 25); and a CDR3 comprising at least 14 or 15 contiguous amino acids of ASPDLTMVFVPHTGPLDF (SEQ ID NO: 27);

b) a CDR1 comprising GGSFTSFV (SEQ ID NO: 23); a CDR2 comprising VIPIFATP (SEQ ID NO: 25); and a CDR3 comprising ASPDLTMVFVPHTGPLDF (SEQ ID NO: 27);

c) a heavy chain variable domain comprising: a CDR1 comprising or consisting of GGSFTSFV (SEQ ID NO: 23); a CDR2 comprising or consisting of VIPIFATP (SEQ ID NO: 25); and a CDR3 comprising or consisting of ASPDLTM-VFVPHTGPLDF (SEQ ID NO: 27);

d) a heavy chain variable domain comprising: QVQLVQS-GAEVKRPGSSVTVSCKASG GSFTSFVISWVRQAPGQGLEWMGGVIPIFATPKY AQKFQGRLTITADKSTNTAYMELTSLRSEDTAMYYCA (SEQ ID NO: 21) or the 09-2A06 heavy chain variable domain amino acid sequence provided in column O of FIG. 12;

e) a CDR1 comprising at least 5 contiguous amino acids of QSIDNW (SEQ ID NO: 33); a CDR2 comprising at least 2 contiguous amino acids of KAS (SEQ ID NO: 35); and a CDR3 comprising at least 8 contiguous amino acids of QHY-DTYSGT (SEQ ID NO: 37);

f) a CDR1 comprising QSIDNW (SEQ ID NO: 33); a CDR2 comprising KAS (SEQ ID NO: 35); and a CDR3 comprising QHYDTYSGT (SEQ ID NO: 37);

g) a light chain variable domain comprising: a CDR1 comprising or consisting of QSIDNW (SEQ ID NO: 33); a CDR2 comprising or consisting of KAS (SEQ ID NO: 35); and a CDR3 comprising or consisting of QHYDTYSGT (SEQ ID NO: 37);

h) a light chain variable domain comprising: DIQMTQSP-STLSASVGDRVTITCRAS QSIDNWLAWYQQKPGKAPNLLIYKASSLRSGVPSR FSGSGSGTEFTLTISSLQPDDFATYYCQHYDTY (SEQ ID NO: 31) or the 09-2A06 light chain variable domain amino acid sequence provided in column O of FIG. 12.

In further embodiments, the antibody (09-3A01), antibody fragment or peptide comprises:

a) a CDR1 comprising at least 8 contiguous amino acids of GGSITSNTYY (SEQ ID NO: 43); a CDR2 comprising at least 7 contiguous amino acids of ISFSGRT (SEQ ID NO: 45); and a CDR3 comprising at least 14 or 15 contiguous amino acids of ARQLTGMVYAILLPSYFDF (SEQ ID NO: 47);

b) a CDR1 comprising GGSITSNTYY (SEQ ID NO: 43); a CDR2 comprising ISFSGRT (SEQ ID NO: 45); and a CDR3 comprising ARQLTGMVYAILLPSYFDF (SEQ ID NO: 47);

c) a heavy chain variable domain comprising: a CDR1 comprising or consisting of GGSITSNTYY (SEQ ID NO: 43); a CDR2 comprising or consisting of ISFSGRT (SEQ ID NO: 45); and a CDR3 comprising or consisting of ARQLT-GMVYAILLPSYFDF (SEQ ID NO: 47);

d) a heavy chain variable domain comprising: RLQLQES-GPGLVKPSETLSLTCTVS GGSITSNTYYWGWIRQPPGKGLESIGSISFSGRTYYSP SLKSRVTMSVDTSKNQFSLKLSSVTAADTAFYYCAR (SEQ ID NO: 41) or the 0 9-3A01 heavy chain variable domain amino acid sequence provided in column O of FIG. 12;

e) a CDR1 comprising at least 5 contiguous amino acids of QSIGSW (SEQ ID NO: 53); a CDR2 comprising at least 2 contiguous amino acids of KAS (SEQ ID NO: 55); and a CDR3 comprising at least 8 contiguous amino acids of QQHNSYSGA (SEQ ID NO: 57);

f) a CDR1 comprising QSIGSW (SEQ ID NO: 53); a CDR2 comprising KAS (SEQ ID NO: 55); and a CDR3 comprising QQHNSYSGA (SEQ ID NO: 57);

g) a light chain variable domain comprising: a CDR1 comprising or consisting of QSIGSW (SEQ ID NO: 53); a CDR2 comprising or consisting of KAS (SEQ ID NO: 55); and a CDR3 comprising or consisting of QQHNSYSGA (SEQ ID NO: 57);

h) a light chain variable domain comprising: DIQMTQSP-STLSASVGDRVTITCRAS QSIGSWLAWYQQKPGKAPKWYKASTLESGVPSRF SGSGSGTEFTLTISSLQPDDLATYYCQQHNSY (SEQ ID NO: 51) or the 0 9-3A01 light chain variable domain amino acid sequence provided in column O in FIG. 12.

In some embodiments, antibodies are disclosed herein, wherein the antibody includes:

a) a heavy chain variable domain comprising: a CDR1 comprising or consisting of GYTFSNYG (SEQ ID NO: 3); a CDR2 comprising or consisting of ISAYNGHT (SEQ ID NO: 5); and a CDR3 comprising or consisting of ARDRRDLLTGSLGDY (SEQ ID NO: 7) and a light chain variable domain comprising: a CDR1 comprising or consisting of RGLLYIDGNTY (SEQ ID NO: 13); a CDR2 comprising or consisting of NVS (SEQ ID NO: 15); and a CDR3 comprising or consisting of MQGTYWPFT (SEQ ID NO: 17);

b) a heavy chain variable domain comprising: a CDR1 comprising or consisting of GGSFTSFV (SEQ ID NO: 23); a CDR2 comprising or consisting of VIPIFATP (SEQ ID NO: 25); and a CDR3 comprising or consisting of ASPDLTM-VFVPHTGPLDF (SEQ ID NO: 27) and a light chain variable domain comprising: a CDR1 comprising or consisting of QSIDNW (SEQ ID NO: 33); a CDR2 comprising or consisting of KAS (SEQ ID NO: 35); and a CDR3 comprising or consisting of QHYDTYSGT (SEQ ID NO: 37); or c) a heavy chain variable domain comprising: a CDR1 comprising or consisting of GGSITSNTYY (SEQ ID NO: 43); a CDR2 comprising or consisting of ISFSGRT (SEQ ID NO: 45); and a CDR3 comprising or consisting of ARQLT-GMVYAILLPSYFDF (SEQ ID NO: 47) and a light chain variable domain comprising: a CDR1 comprising or consisting of QSIGSW (SEQ ID NO: 53); a CDR2 comprising or consisting of KAS (SEQ ID NO: 55); and a CDR3 comprising or consisting of QQHNSYSGA (SEQ ID NO: 57).

In some embodiments, an antibody or antigen binding fragment thereof is provided that includes a heavy chain variable domain and a light chain variable domain, wherein the heavy chain variable domain includes one of: a) the amino acid sequence set forth as SEQ ID NO: 3, the amino acid sequence set for the as SEQ ID NO: 5 and the amino acid sequence set forth as SEQ ID NO: 7 [005-2G02]; b) the amino acid sequence set forth as SEQ ID NO: 23, the amino acid sequence set for the as SEQ ID NO: 25 and the amino acid sequence set forth as SEQ ID NO: 27 [09-2A06]; or c) the amino acid sequence set forth as SEQ ID NO: 43, the amino acid sequence set forth as SEQ ID NO: 45 and the amino acid sequence set forth as SEQ ID NO: 47 [09-3A01]. In further embodiments, the antibody or antigen binding fragment thereof includes a) a heavy chain variable domain including the amino acid sequence set forth as SEQ ID NO: 3, the amino acid sequence set forth as SEQ ID NO: 5 and the amino acid sequence set forth as SEQ ID NO: 7, and a light chain variable domain including the amino acid sequence set forth as SEQ ID NO: 13, the amino acid sequence set for the as SEQ ID NO: 15 and the amino acid sequence set forth as SEQ ID NO: 17 [005-2G02]; b) a heavy chain variable domain including the amino acid sequence set forth as SEQ ID NO: 23, the amino acid sequence set for the as SEQ ID NO: 25 and the amino acid sequence set forth as SEQ ID NO: 27, and a light chain variable domain including the amino acid sequence set forth as SEQ ID NO: 33, the amino acid sequence set for the as SEQ ID NO: 35 and the amino acid sequence set forth as SEQ ID NO: 37 [09-2A06]; or c) a heavy chain variable domain including the amino acid sequence set forth as SEQ ID NO: 43, the amino acid sequence set for the as SEQ ID NO: 45 and the amino acid sequence set forth as SEQ ID NO: 47 [09-3A01]; and a light chain variable domain including the amino acid sequence set forth as SEQ ID NO: 53, the amino acid sequence set for the as SEQ ID NO: 55 and the amino acid sequence set forth as SEQ ID NO: 57. These monoclonal antibodies and antigen binding fragments specifically bind influenza HA.

In further embodiments, the heavy chain variable domain of the antibody or antigen binding fragment includes one of a) the amino acid sequence set forth as SEQ ID NO: 1; b) the amino acid sequence set forth as SEQ ID NO: 21; or c) the amino acid sequence set forth as SEQ ID NO: 41. In other embodiments, the heavy chain variable domain includes or consists of one of: a) the amino acid sequence set forth as SEQ ID NO: 9; b) the amino acid sequence set forth as SEQ ID NO: 29; or c) the amino acid sequence set forth as SEQ ID NO: 49. In further embodiments, the heavy chain variable domain has an amino acid sequence at least 90%, 91%, 92%, 93%, 94%, 95%, 96%, 97%, 98%, 99% or 100% identical to the amino acid sequence set for the as the amino acid sequence set forth as SEQ ID NO: 9, SEQ ID NO: 29 and/or SEQ ID NO: 49. In yet other embodiments, the heavy chain variable domain includes 1, 2, 3, 4, 5, 6, 7, 8, 9 or 10 amino acid substitutions in the amino acid sequence set forth as SEQ ID NO: 9, SEQ ID NO: 29 and/or SEQ ID NO: 49. These monoclonal antibodies and antigen binding fragments specifically bind influenza HA.

In additional embodiments, the light chain variable domain includes one of a) the amino acid sequence set forth as SEQ ID NO: 11; b) the amino acid sequence set forth as SEQ ID NO: 31; or c) the amino acid sequence set forth as SEQ ID NO: 51. In other embodiments, the light chain variable domain includes or consists of a) the amino acid sequence set forth as SEQ ID NO: 19; b) the amino acid sequence set forth as SEQ ID NO: 39; or c) the amino acid sequence set forth as SEQ ID NO: 59. In further embodiments, the light chain variable domain has an amino acid sequence at least 90%, 91%, 92%, 93%, 94%, 95%, 96%, 97%, 98%, 99% or 100% identical to the amino acid sequence set for the as the amino acid sequence set forth as SEQ ID NO: 19, SEQ ID NO: 39 and/or SEQ ID NO: 59. In yet other embodiments, the light chain variable domain includes 1, 2, 3, 4, 5, 6, 7, 8, 9 or 10 amino acid substitutions in the amino acid sequence set forth as SEQ ID NO: 19, SEQ ID NO: 39 and/or SEQ ID NO: 59. These monoclonal antibodies and antigen binding fragments specifically bind influenza HA.

In some embodiments, a) the heavy chain variable domain includes the amino acid sequence set forth as SEQ ID NO: 1 and the light chain variable domain includes the amino acid sequence set forth as SEQ ID NO: 11; b) the heavy chain variable domain includes the amino acid sequence set forth as SEQ ID NO: 21 and the light chain variable domain includes the amino acid sequence set forth as SEQ ID NO: 31; or c) the heavy chain variable domain includes the amino acid sequence set forth as SEQ ID NO: 41 and the light chain variable domain includes the amino acid sequence set forth as SEQ ID NO: 51, wherein the monoclonal antibody or antigen binding fragment specifically binds influenza HA. In yet other embodiments, a) the heavy chain variable domain includes or consists of the amino acid sequence set forth as SEQ ID NO: 9 and the light chain variable domain includes or consists of SEQ ID NO: 19; b) the heavy chain variable domain includes or consists of the amino acid sequence set forth as SEQ ID NO: 29 and the light chain variable domain includes or consists of the amino acid sequence set forth as SEQ ID NO: 39; or c) the heavy chain variable domain includes or consists of the amino acid sequence set forth as SEQ ID NO: 49 and the light chain variable domain includes or consists of the amino acid sequence set forth as SEQ ID NO: 59, wherein the monoclonal antibody or antigen binding fragment specifically binds influenza HA.

In some embodiments, an antibody is provided that binds the same epitope of HA as does the monoclonal antibodies 05-2G02, 09-2A06 and 09-3A01. These antibodies can be identified using assays such as, but not limited to, competitive binding assays.

Also disclosed herein is a sterile composition including the purified antibody or antibody fragment and a sterile composition comprising the purified antibody or antibody fragment and a pharmaceutically acceptable carrier. Pharmaceutical compositions are disclosed below.

The antibodies can be modified in the Fc region to provide desired effector functions or serum half-life. With the appropriate Fc regions, the naked antibody bound on the cell surface can induce cytotoxicity, e.g., via antibody-dependent cellular cytotoxicity (ADCC) or by recruiting complement in complement dependent cytotoxicity (CDC), or by recruiting nonspecific cytotoxic cells that express one or more effector ligands that recognize bound antibody on a influenza cell and subsequently cause phagocytosis of the influenza cell in antibody dependent cell-mediated phagocytosis (ADCP), or some other mechanism.

Where it is desirable to eliminate or reduce effector function, so as to minimize side effects or therapeutic complications, certain other Fc regions may be used. The Fc region of the antibodies of the invention can be modified to increase the binding affinity for FcRn and thus increase serum half-life. Alternatively, the Fc region can be conjugated to PEG or albumin to increase the serum half-life, or some other conjugation that results in the desired effect.

It is known that variants of the Fc region (e.g., amino acid substitutions and/or additions and/or deletions) enhance or diminish effector function of the antibody (See e.g., U.S. Pat. Nos. 5,624,821; 5,885,573; 6,538,124; 7,317,091; 5,648,260; 6,538,124; PCT Publication Nos. WO 03/074679; WO 04/029207; WO 04/099249; WO 99/58572; and US Published Patent Application Nos. 2006/0134105; 2004/0132101; 2006/0008883) and may alter the pharmacokinetic properties (e.g. half-life) of the antibody (see, U.S. Pat. Nos. 6,277,375 and 7,083,784). Thus, in certain embodiments, the anti-influenza antibodies include an altered Fc region (also referred to herein as "variant Fc region") in which one or more alterations have been made in the Fc region in order to change functional and/or pharmacokinetic properties of the antibodies. The serum half-life of proteins comprising Fc regions may be increased by increasing the binding affinity of the Fc region for FcRn. The term "antibody half-life" as used herein means a pharmacokinetic property of an antibody that is a measure of the mean survival time of antibody molecules following their administration. Antibody half-life can be expressed as the time required to eliminate 50 percent of a known quantity of immunoglobulin from the patient's body (or other mammal) or a specific compartment thereof, for example, as measured in serum, i.e., circulating half-life, or in other tissues. Half-life may vary from one immunoglobulin or class of immunoglobulin to another. In general, an increase in antibody half-life results in an increase in mean residence time (MRT) in circulation for the antibody administered. In a specific embodiment, the present invention provides an Fc variant antibody, wherein the Fc region comprises at least one non-naturally occurring amino acid at one or more positions selected from the group consisting of 252, 254, and 256. In one embodiment, the non-naturally occurring amino acids are selected from the group consisting of 252Y, 254T and 256E.

Diabodies are also provided herein. Diabodies are small antibody fragments with two antigen-binding sites, which fragments comprise a heavy chain variable domain ($V_H$) connected to a light chain variable domain ($V_L$) in the same polypeptide chain ($V_H$ and $V_L$). By using a linker that is too short to allow pairing between the two domains on the same chain, the domains are forced to pair with the complementary domains of another chain and create two antigen-binding site (see e.g., Holliger et al. (1993) *Proc. Natl. Acad. Sci. USA* 90:6444; Poljak et al. (1994) *Structure* 2:1121).

Linear antibodies are also provided herein. Linear antibodies include a pair of tandem Fd segments ($V_H$-CH1-$V_H$-CH1) which, together with complementary light chain polypeptides, form a pair of antigen binding regions. Linear antibodies can be bispecific or monospecific.

The antibodies disclosed herein specifically include chimeric antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity.

An antigen binding portion of an antibody specifically binds to an antigen (e.g., H1N1, H5N1 and/or H3N2). It has been shown that the antigen-binding function of an antibody can be performed by fragments of a full-length antibody, including:

(i) a Fab fragment, a monovalent fragment consisting of the $V_L$, $V_H$, $C_L$ and CH1 domains;
(ii) a F(ab')$_2$ fragment, a bivalent fragment comprising two Fab fragments linked by a disulfide bridge at the hinge region;
(iii) a Fd fragment consisting of the $V_H$ and CH1 domains;
(iv) a Fv fragment consisting of the $V_L$ and $V_H$ domains of a single arm of an antibody,
(v) a dAb fragment (Ward et al, (1989) Nature 341:544 546), which consists of a $V_H$ domain; and
(vi) an isolated complementarity determining region (CDR).

Antibody portions, such as Fab and F(ab')$_2$ fragments, can be prepared from whole antibodies using conventional techniques, such as papain or pepsin digestion, respectively, of whole antibodies. Furthermore, although the two domains of the Fv fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules (known as single chain Fv (scFv); see e.g., Bird et al. (1988) Science 242:423 426; and Huston et al. (1988) Proc. Natl. Acad. Sci. USA 85:5879 5883). Single chain Fv and other forms of single chain antibodies, such as diabodies are also encompassed by the present disclosure.

Any of the antibody or antigen-binding fragments disclosed herein can be part of a larger immunoadhesion molecule, formed by covalent or noncovalent association of the antibody or antibody portion with one or more other proteins or peptides. Examples of such immunoadhesion molecules include use of the streptavidin core region to make a tetrameric scFv molecule (Kipriyanov et al. (1995) *Human Antibodies and Hybridomas* 6:93) and use of a cysteine residue, a marker peptide and a C-terminal polyhistidine tag to make bivalent and biotinylated scFv molecules (Kipriyanov et al. (1994) *Mol. Immunol.* 31:1047).

Human antibodies are also disclosed herein that include antibodies having variable and constant regions derived from (or having the same amino acid sequence as those derived from) human germline immunoglobulin sequences. Human antibodies can include amino acid residues not encoded by human germline immunoglobulin sequences (e.g., mutations introduced by random or site-specific mutagenesis in vitro or by somatic mutation in vivo), for example in the CDRs and in particular CDR3.

The antibodies or antibody fragments disclosed herein can be derivatized or linked to another molecule (such as another peptide or protein). In general, the antibody or portion thereof is derivatized such that the binding to HA is not affected adversely by the derivatization or labeling. For example, the antibody can be functionally linked (by chemical coupling, genetic fusion, noncovalent association or otherwise) to one or more other molecular entities, such as another antibody (for example, a bispecific antibody or a diabody), a detection agent, a pharmaceutical agent, and/or a protein or peptide that can mediate associate of the antibody or antibody portion with another molecule (such as a streptavidin core region or a polyhistidine tag).

One type of derivatized antibody is produced by cross-linking two or more antibodies (of the same type or of different types, such as to create bispecific antibodies). Suitable crosslinkers include those that are heterobifunctional, having two distinctly reactive groups separated by an appropriate spacer (such as m-maleimidobenzoyl-N-hydroxysuccinimide ester) or homobifunctional (such as disuccinimidyl suberate). Such linkers are available from Pierce Chemical Company (Rockford, Ill.).

An antibody that specifically binds HA can be labeled with a detectable moiety. Useful detection agents include fluorescent compounds, including fluorescein, fluorescein isothiocyanate, rhodamine, 5-dimethylamine-1-napthalenesulfonyl chloride, phycoerythrin, lanthanide phosphors and the like. Bioluminescent markers are also of use, such as luciferase, green fluorescent protein, or yellow fluorescent protein. An antibody can also be labeled with enzymes that are useful for detection, such as horseradish peroxidase, β-galactosidase, luciferase, alkaline phosphatase, glucose oxidase and the like. When an antibody is labeled with a detectable enzyme, it can be detected by adding additional reagents that the enzyme uses to produce a reaction product that can be discerned. For example, when the agent horseradish peroxidase is present the addition of hydrogen peroxide and diaminobenzidine leads to a colored reaction product, which is visually detectable. An antibody may also be labeled with biotin, and detected through indirect measurement of avidin or streptavidin binding. It should be noted that the avidin itself can be labeled with an enzyme or a fluorescent label.

An antibody may be labeled with a magnetic agent, such as gadolinium. Antibodies can also be labeled with lanthanides (such as europium and dysprosium), and manganese. Paramagnetic particles such as superparamagnetic iron oxide are also of use as labels. An antibody may also be labeled with a predetermined polypeptide epitopes recognized by a secondary reporter (such as leucine zipper pair sequences, binding sites for secondary antibodies, metal binding domains, epitope tags). An antibody can also be labeled with a radiolabeled amino acid. The radiolabel may be used for both diagnostic and therapeutic purposes. Examples of labels include, but are not limited to, the following radioisotopes or radionucleotides: $^{3}$H, $^{14}$C, $^{15}$N, $^{35}$S, $^{90}$Y, $^{99}$Tc, $^{111}$In, $^{125}$I, $^{131}$I. In some embodiments, labels are attached by spacer arms of various lengths to reduce potential steric hindrance.

An antibody can also be derivatized with a chemical group such as polyethylene glycol (PEG), a methyl or ethyl group, or a carbohydrate group. These groups may be useful to improve the biological characteristics of the antibody, such as to increase serum half-life or to increase tissue binding.

Means of detecting such labels are well known to those of skill in the art. Thus, for example, radiolabels may be detected using photographic film or scintillation counters, fluorescent markers may be detected using a photodetector to detect emitted illumination. Enzymatic labels are typically detected by providing the enzyme with a substrate and detecting the reaction product produced by the action of the enzyme on the substrate, and colorimetric labels are detected by simply visualizing the colored label.

Polynucleotides and Expression

Nucleotide sequences encoding the amino acid sequences disclosed herein, including $V_H$, $V_L$, CDR and FR sequences can be prepared; exemplary nucleic acid sequences encoding a $V_H$ and a $V_L$ are shown in FIG. 12. Expression vectors are also provided for efficient expression in cells (e.g. mammalian cells).

Recombinant expression of an antibody, antigen binding fragment thereof or portion thereof (such as a CDR or FR) generally requires construction of an expression vector containing a polynucleotide that encodes the antibody or antibody fragment. Replicable vectors are provided including a nucleotide sequence encoding an antibody molecule, a heavy or light chain of an antibody, a heavy or light chain variable domain of an antibody or a portion thereof, or a heavy or light chain CDR, operably linked to a promoter. Such vectors may include the nucleotide sequence encoding the constant region of an antibody molecule (see, e.g., U.S. Pat. Nos. 5,981,216; 5,591,639; 5,658,759 and 5,122,464) and the variable domain of the antibody may be cloned into such a vector for expression of the entire heavy, the entire light chain, or both the entire heavy and light chains.

Nucleic acid molecules (also referred to as polynucleotides) encoding the polypeptides provided herein (including, but not limited to antibodies) can readily be produced by one of skill in the art. For example, these nucleic acids can be produced using the amino acid sequences provided herein (such as the CDR sequences, heavy chain and light chain sequences), sequences available in the art (such as framework sequences), and the genetic code. Thus, degenerate variants are provided herein.

$V_H$ nucleic acid sequences are set forth as SEQ ID NOS 8, 28, 48, 68, 88, 108, 128, 148, 168, 188, 208, 228, 248, 268, 288, 308, 328, 348, 368, 388, 408, 428, 448, 468, 488, 508, 528, 548, 568, 588, 608, 628, 648, 668, 688, 708, 728, 748, 768, 788, 808, 828, 848, 868, 888, 908, 928, 948, 968, 988, 1008, 1028, 1048, 1068, 1088, 1108, 1128, 1148, 1168, 1188, 1208, 1228, 1248, 1268, 1288, 1308, 1328, 1348, 1368, and 1388 and include degenerate variants; $V_L$ nucleic acid sequences are set forth as SEQ ID NO S 18, 38, 58, 78, 98, 118, 138, 158, 178, 198, 218, 238, 258, 278, 298, 318, 338, 358, 378, 398, 418, 438, 458, 478, 498, 518, 538, 558, 578, 598, 618, 638, 658, 678, 698, 718, 738, 758, 778, 798, 818, 838, 858, 878, 898, 918, 938, 958, 978, 998, 1018, 1038, 1058, 1078, 1098, 1118, 1138, 1158, 1178, 1198, 1218, 1238, 1258, 1278, 1298, 1318, 1338, 1358, 1378, and 1398, and include degenerate variants thereof. One of skill in the art can readily use the genetic code to construct a variety of functionally equivalent nucleic acids, such as nucleic acids which differ in sequence but which encode the same antibody sequence, or encode a conjugate or fusion protein including the $V_L$ and/or $V_H$ nucleic acid sequence.

Nucleic acid sequences encoding the antibodies that specifically bind HA, such as the stalk of HA can be prepared by any suitable method including, for example, cloning of appropriate sequences or by direct chemical synthesis by methods such as the phosphotriester method of Narang et al., *Meth. Enzymol.* 68:90-99, 1979; the phosphodiester method of Brown et al., *Meth. Enzymol.* 68:109-151, 1979; the diethylphosphoramidite method of Beaucage et al., *Tetra. Lett.* 22:1859-1862, 1981; the solid phase phosphoramidite triester method described by Beaucage & Caruthers, *Tetra. Letts.* 22(20):1859-1862, 1981, for example, using an automated synthesizer as described in, for example, Needham-VanDevanter et al., *Nucl. Acids Res.* 12:6159-6168, 1984; and, the solid support method of U.S. Pat. No. 4,458,066. Chemical synthesis produces a single stranded oligonucleotide. This can be converted into double stranded DNA by hybridization with a complementary sequence or by polymerization with a DNA polymerase using the single strand as a template. One of skill would recognize that while chemical synthesis of DNA is generally limited to sequences of about 100 bases, longer sequences may be obtained by the ligation of shorter sequences.

Exemplary nucleic acids can be prepared by cloning techniques. Examples of appropriate cloning and sequencing techniques, and instructions sufficient to direct persons of skill through many cloning exercises are found in Sambrook et al., supra, Berger and Kimmel (eds.), supra, and Ausubel, supra. Product information from manufacturers of biological reagents and experimental equipment also provide useful information. Such manufacturers include the SIGMA Chemical Company (Saint Louis, Mo.), R&D Systems (Minneapolis, Minn.), Pharmacia Amersham (Piscataway, N.J.), CLONTECH Laboratories, Inc. (Palo Alto, Calif.), Chem Genes Corp., Aldrich Chemical Company (Milwaukee, Wis.), Glen Research, Inc., GIBCO BRL Life Technologies, Inc. (Gaithersburg, Md.), Fluka Chemica-Biochemika Analytika (Fluka Chemie AG, Buchs, Switzerland), Invitrogen (Carlsbad, Calif.), and Applied Biosystems (Foster City, Calif.), as well as many other commercial sources known to one of skill Nucleic acids can also be prepared by amplification methods. Amplification methods include polymerase chain reaction (PCR), the ligase chain reaction (LCR), the transcription-based amplification system (TAS), the self-sustained sequence replication system (3SR). A wide variety of cloning methods, host cells, and in vitro amplification methodologies are well known to persons of skill Any of the nucleic acids encoding any of the antibodies, CDRs, FRs, $V_H$ and/or $V_L$, disclosed herein (or fragment thereof) can be expressed in a recombinantly engineered cell such as bacteria, plant, yeast, insect and mammalian cells. These antibodies can be expressed as individual $V_H$ and/or $V_L$ chain, or can be expressed as a fusion protein. An immunoadhesin can also be expressed. Thus, in some examples, nucleic acids encoding a $V_H$ and $V_L$, and immunoadhesin are provided. The nucleic acid sequences can optionally encode a leader sequence.

To create a single chain antibody, (scFv) the $V_H$- and $V_L$-encoding DNA fragments are operatively linked to another fragment encoding a flexible linker, e.g., encoding the amino acid sequence $(Gly_4-Ser)_3$ (SEQ ID NO: 1541), such that the $V_H$ and $V_L$ sequences can be expressed as a contiguous single-chain protein, with the $V_L$ and $V_H$ domains joined by the flexible linker (see, e.g., Bird et al., Science 242:423-426, 1988; Huston et al., Proc. Natl. Acad. Sci. USA 85:5879-5883, 1988; McCafferty et al., Nature 348:552-554, 1990). Optionally, a cleavage site can be included in a linker, such as a furin cleavage site.

The nucleic acid encoding the $V_H$ and/or the $V_L$ optionally can encode an Fc domain (immunoadhesin). The Fc domain can be an IgA, IgM or IgG Fc domain. The Fc domain can be an optimized Fc domain, as described in U.S. Published Patent Application No. 20100/093979, incorporated herein by reference. In one example, the immunoadhesin is an $IgG_1$ Fc.

The single chain antibody may be monovalent, if only a single $V_H$ and $V_L$ are used, bivalent, if two $V_H$ and $V_L$ are used, or polyvalent, if more than two $V_H$ and $V_L$ are used. Bispecific or polyvalent antibodies may be generated that bind specifically to HA and another antigen, such as, but not limited to another influenza protein, or that bind two different HA epitopes. The encoded $V_H$ and $V_L$ optionally can include a furin cleavage site between the $V_H$ and $V_L$ domains.

It is expected that those of skill in the art are knowledgeable in the numerous expression systems available for expression of proteins including *E. coli*, other bacterial hosts, yeast, and various higher eukaryotic cells such as the COS, CHO, HeLa and myeloma cell lines. Once the expression vector is transferred to a host cell by conventional techniques, the transfected cells are then cultured by conventional techniques, such as to produce an antibody. Thus, host cells are provided containing a polynucleotide encoding an antibody or fragments thereof, or a heavy or light chain thereof, or portion thereof, or a single-chain antibody of the invention, operably linked to a heterologous promoter. In certain embodiments for the expression of double-chained antibodies, vectors encoding both the heavy and light chains may be co-expressed in the host cell for expression of the entire immunoglobulin molecule, as detailed below.

Mammalian cell lines available as hosts for expression of recombinant antibodies are well known in the art and include many immortalized cell lines available from the American Type Culture Collection (ATCC), including but not limited to Chinese hamster ovary (CHO) cells, HeLa cells, baby hamster kidney (BHK) cells, monkey kidney cells (COS), human hepatocellular carcinoma cells (e.g., Hep G2), human epithelial kidney 293 cells, and a number of other cell lines. Different host cells have characteristic and specific mechanisms for the post-translational processing and modification of proteins and gene products. Appropriate cell lines or host systems can be chosen to ensure the correct modification and processing of the antibody or portion thereof expressed. To this end, eukaryotic host cells which possess the cellular machinery for proper processing of the primary transcript, glycosylation, and phosphorylation of the gene product may be used. Such mammalian host cells include but are not limited to CHO, VERY, BHK, Hela, COS, MDCK, 293, 3T3, W138, BT483, Hs578T, HTB2, BT2O and T47D, NS0 (a murine myeloma cell line that does not endogenously produce any functional immunoglobulin chains), SP20, CRL7O3O and HsS78Bst cells. In one embodiment, human cell lines developed by immortalizing human lymphocytes can be used to recombinantly produce monoclonal antibodies. In one embodiment, the human cell line PER.C6. (Crucell, Netherlands) can be used. Additional cell lines which may be used as hosts for expression of recombinant antibodies include, but are not limited to, insect cells (e.g. Sf21/Sf9, *Trichoplusia ni* Bti-Tn5b1-4) or yeast cells (e.g. *S. cerevisiae*, *Pichia*, U.S. Pat. No. 7,326,681; etc), plants cells (for example, see US Published Patent Application No. 20080066200); and chicken cells (for example, see PCT Publication No. WO2008142124).

The host cell can be a gram positive bacteria including, but not limited to, *Bacillus, Streptococcus, Streptomyces, Staphylococcus, Enterococcus, Lactobacillus, Lactococcus, Clostridium, Geobacillus*, and *Oceanobacillus*. Methods for expressing protein in gram positive bacteria, such as *Lactobaccillus* are well known in the art, see for example, U.S. Published Patent Application No. 20100/080774. Expression vectors for *lactobacillus* are described, for example in U.S. Pat. No. 6,100,388, and U.S. Pat. No. 5,728,571. Leader sequences can be included for expression in *Lactobacillus*. Gram negative bacteria include, but not limited to, *E. coli, Pseudomonas, Salmonella, Campylobacter, Helicobacter, Flavobacterium, Fusobacterium, Ilyobacter, Neisseria*, and *Ureaplasma*.

One or more DNA sequences encoding the antibody or fragment thereof can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art.

The expression of nucleic acids encoding the isolated proteins described herein can be achieved by operably linking the DNA or cDNA to a promoter (which is either constitutive or inducible), followed by incorporation into an expression cassette. The promoter can be any promoter of interest, including a cytomegalovirus promoter and a human T cell lymphotrophic virus promoter (HTLV)-1. Optionally, an enhancer, such as a cytomegalovirus enhancer, is included in the construct. The cassettes can be suitable for replication and integration in either prokaryotes or eukaryotes. Typical expression cassettes contain specific sequences useful for regulation of the expression of the DNA encoding the protein. For example, the expression cassettes can include appropriate promoters, enhancers, transcription and translation terminators, initiation sequences, a start codon (i.e., ATG) in front of a protein-encoding gene, splicing signal for introns, sequences for the maintenance of the correct reading frame of that gene to permit proper translation of mRNA, and stop codons. The vector can encode a selectable marker, such as a marker encoding drug resistance (for example, ampicillin or tetracycline resistance).

To obtain high level expression of a cloned gene, it is desirable to construct expression cassettes which contain, at the minimum, a strong promoter to direct transcription, a ribosome binding site for translational initiation (internal ribosomal binding sequences), and a transcription/translation terminator. For *E. coli*, this includes a promoter such as the T7, trp, lac, or lambda promoters, a ribosome binding site, and preferably a transcription termination signal. For eukaryotic cells, the control sequences can include a promoter and/or an enhancer derived from, for example, an immunoglobulin gene, HTLV, SV40 or cytomegalovirus, and a polyadenylation sequence, and can further include splice donor and/or acceptor sequences (for example, CMV and/or HTLV splice acceptor and donor sequences). The cassettes can be transferred into the chosen host cell by well-known methods such as transformation or electroporation for *E. coli* and calcium phosphate treatment, electroporation or lipofection for mammalian cells. Cells transformed by the cassettes can be selected by resistance to antibiotics conferred by genes contained in the cassettes, such as the amp, gpt, neo and hyg genes.

When the host is a eukaryote, such methods of transfection of DNA as calcium phosphate coprecipitates, conventional mechanical procedures such as microinjection, electroporation, insertion of a plasmid encased in liposomes, or virus vectors may be used. Eukaryotic cells can also be cotransformed with polynucleotide sequences encoding the antibody, labeled antibody, or functional fragment thereof, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, *Eukaryotic Viral Vectors*, Cold Spring Harbor Laboratory, Gluzman ed., 1982). One of skill in the art can readily use an expression systems such as plasmids and vectors of use in producing proteins in cells including higher eukaryotic cells such as, but not limited to, COS, CHO, HeLa and myeloma cell lines.

Modifications can be made to a nucleic acid encoding a polypeptide described herein without diminishing its biological activity. Some modifications can be made to facilitate the cloning, expression, or incorporation of the targeting molecule into a fusion protein. Such modifications are well known to those of skill in the art and include, for example, termination codons, a methionine added at the amino terminus to provide an initiation, site, additional amino acids placed on either terminus to create conveniently located restriction sites, or additional amino acids (such as poly His) to aid in purification steps.

Once expressed, the recombinant immunoconjugates, antibodies, and/or effector molecules (such as a label) can be purified according to standard procedures of the art, including ammonium sulfate precipitation, affinity columns, column chromatography, and the like (see, generally, R. Scopes, PROTEIN PURIFICATION, Springer-Verlag, N.Y., 1982). The antibodies, immunoconjugates and effector molecules need not be 100% pure. Once purified, partially or to homogeneity as desired, if to be used therapeutically, the polypeptides should be substantially free of endotoxin.

Methods for expression of antibodies and/or refolding to an appropriate active form, including single chain antibodies, from bacteria such as *E. coli* have been described and are well-known and are applicable to the antibodies disclosed herein. See, Buchner et al., *Anal. Biochem.* 205:263-270, 1992; Pluckthun, *Biotechnology* 9:545, 1991; Huse et al., *Science* 246:1275, 1989 and Ward et al., *Nature* 341:544, 1989.

Often, functional heterologous proteins from *E. coli* or other bacteria are isolated from inclusion bodies and require solubilization using strong denaturants, and subsequent refolding. During the solubilization step, as is well known in the art, a reducing agent must be present to separate disulfide bonds. An exemplary buffer with a reducing agent is: 0.1 M Tris pH 8, 6 M guanidine, 2 mM EDTA, 0.3 M DTE (dithioerythritol). Reoxidation of the disulfide bonds can occur in the presence of low molecular weight thiol reagents in reduced and oxidized form, as described in Saxena et al., *Biochemistry* 9: 5015-5021, 1970, and especially as described by Buchner et al., supra.

Renaturation is typically accomplished by dilution (for example, 100-fold) of the denatured and reduced protein into refolding buffer. An exemplary buffer is 0.1 M Tris, pH 8.0, 0.5 M L-arginine, 8 mM oxidized glutathione (GSSG), and 2 mM EDTA.

As a modification to the two chain antibody purification protocol, the heavy and light chain regions are separately solubilized and reduced and then combined in the refolding solution. An exemplary yield is obtained when these two proteins are mixed in a molar ratio such that a 5-fold molar excess of one protein over the other is not exceeded. Excess oxidized glutathione or other oxidizing low molecular weight compounds can be added to the refolding solution after the redox-shuffling is completed.

In addition to recombinant methods, immunoconjugates, effector moieties, antibodies, antigen binding fragments, and CDRs and FRs of the present disclosure can also be constructed in whole or in part using standard peptide synthesis well known in the art. Solid phase synthesis of the polypeptides of less than about 50 amino acids in length can be accomplished by attaching the C-terminal amino acid of the sequence to an insoluble support followed by sequential addition of the remaining amino acids in the sequence. Techniques for solid phase synthesis are described by Barany & Merrifield, *The Peptides: Analysis, Synthesis, Biology*. Vol. 2: *Special Methods in Peptide Synthesis, Part A*. pp. 3-284; Merrifield et al., *J. Am. Chem. Soc.* 85:2149-2156, 1963, and Stewart et al., *Solid Phase Peptide Synthesis*, 2nd ed., Pierce Chem. Co., Rockford, Ill., 1984. Proteins of greater length may be synthesized by condensation of the amino and carboxyl termini of shorter fragments. Methods of forming peptide bonds by activation of a carboxyl terminal end (such as by the use of the coupling reagent N,N'-dicylohexylcarbodimide) are well known in the art. Once an antibody molecule has been produced, it may be purified by any method known in the art for purification of an immunoglobulin molecule, for example, by chromatography (e.g., ion exchange, affinity, particularly by affinity for the specific antigens Protein A or Protein G, and sizing column chromatography), centrifugation, differential solubility, or by any other standard technique for the purification of proteins. Further, the antibodies or fragments thereof may be fused to heterologous polypeptide sequences (referred to herein as "tags") described above or otherwise known in the art to facilitate purification.

Compositions and Therapeutic Methods

Methods are disclosed herein for the prevention or treatment of an influenza virus infection. Prevention can include inhibition of infection with influenza. Treatment includes diminishing signs and symptoms of an influenza virus infection and/or reducing viral titer. The methods include contacting a cell with an effective amount of the monoclonal antibodies disclosed herein that specifically binds HA, or an antigen binding fragment thereof. The method can also include administering to a subject a therapeutically effective amount of a monoclonal antibody, or a nucleic acid encoding the antibody. The subject can be a human or a veterinary subject.

Methods are disclosed herein for reducing the risk of infection with H1N1 and/or H5N1 and/or H3N2 influenza virus in a human subject, the method including administering the antibody or antibody (antigen-binding) fragment. Methods are also disclosed for treating a human subject infected with H1N1 and/or H5N1 influenza virus, the method including administering the antibody or antibody (antigen-binding) fragment. Methods are also disclosed for preventing H1N1 and/or H5N1 and/or H3N2 influenza disease in a human subject, the method including administering the antibody or antibody (antigen-binding) fragment. Methods are also disclosed for ameliorating one or more symptoms associated with an H1N1 and/or H5N1 or H3N2 influenza infection in a human subject, the method including administering the antibody or antibody (antigen-binding) fragment. The method can include selecting a subject with an influenza virus infection.

In certain embodiments, the anti-influenza antibodies and compositions including one or more of the antibodies can be administered for prevention and/or treatment of influenza disease caused by an H1N1 influenza infection. Methods are provide for preventing, treating, ameliorating a symptom of, or reducing the risk of an influenza-mediated infection, disease or disorder, wherein the methods comprise administering anti-influenza antibodies of the invention.

Influenza virus infection does not need to be completely eliminated for the composition to be effective. For example, a composition can decrease influenza infection in a population by a desired amount, for example by at least 10%, at least 20%, at least 50%, at least 60%, at least 70%, at least 80%, at least 90%, at least 95%, at least 98%, or even at least 100%, as compared to the rate of infection in the absence of the composition.

Compositions are provided that include one or more of the antibodies that specifically bind HA, or antigen binding fragments, and nucleic acids encoding these antibodies (and antigen binding fragments) that are disclosed herein in a carrier. The compositions can be prepared in unit dosage forms for administration to a subject. The amount and timing of administration are at the discretion of the treating physician to achieve the desired purposes. The antibody can be formulated for systemic or local administration. In one example, the antibody that specifically binds HA is formulated for parenteral administration, such as intravenous administration.

The compositions for administration can include a solution of the antibody that specifically binds HA, or an antigen binding fragment thereof, dissolved in a pharmaceutically acceptable carrier, such as an aqueous carrier. A variety of aqueous carriers can be used, for example, buffered saline and the like. These solutions are sterile and generally free of undesirable matter. These compositions may be sterilized by conventional, well known sterilization techniques. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like. The concentration of antibody in these formulations can vary widely, and will be selected primarily based on fluid volumes, viscosities, body weight and the like in accordance with the particular mode of administration selected and the subject's needs.

A typical pharmaceutical composition for intravenous administration includes about 0.1 to 10 mg of antibody per subject per day. Dosages from 0.1 up to about 100 mg per subject per day may be used, particularly if the agent is administered to a secluded site and not into the circulatory or lymph system, such as into a body cavity or into a lumen of an organ. Actual methods for preparing administrable compositions will be known or apparent to those skilled in the art and are described in more detail in such publications as *Remington's Pharmaceutical Science,* 19th ed., Mack Publishing Company, Easton, Pa. (1995).

Antibodies may be provided in lyophilized form and rehydrated with sterile water before administration, although they are also provided in sterile solutions of known concentration. The antibody solution is then added to an infusion bag containing 0.9% sodium chloride, USP, and typically administered at a dosage of from 0.5 to 15 mg/kg of body weight. Considerable experience is available in the art in the administration of antibody drugs, which have been marketed in the U.S. since the approval of RITUXAN® in 1997. Antibodies can be administered by slow infusion, rather than in an intravenous push or bolus. In one example, a higher loading dose is administered, with subsequent, maintenance doses being administered at a lower level. For example, an initial loading dose of 4 mg/kg may be infused over a period of some 90 minutes, followed by weekly maintenance doses for 4-8 weeks of 2 mg/kg infused over a 30 minute period if the previous dose was well tolerated.

A therapeutically effective amount of a nucleic acid encoding the antibody or an antigen binding fragment thereof can be administered to a subject. One approach to administration of nucleic acids is direct immunization with plasmid DNA, such as with a mammalian expression plasmid. The nucleotide sequence encoding the antibody or fragment thereof can be placed under the control of a promoter to increase expression of the molecule. Immunization by nucleic acid constructs is well known in the art and taught, for example, in U.S. Pat. No. 5,643,578, and U.S. Pat. No. 5,593,972 and U.S. Pat. No. 5,817,637. U.S. Pat. No. 5,880,103 describes several methods of delivery of nucleic acids to an organism. The methods include liposomal delivery of the nucleic acids.

In another approach to using nucleic acids, an antibody or antigen binding fragment thereof can also be expressed by attenuated viral hosts or vectors or bacterial vectors, which can be administered to a subject. Recombinant vaccinia virus, adeno-associated virus (AAV), herpes virus, retrovirus, cytomegalovirus, poxvirus or other viral vectors can be used to express the antibody. For example, vaccinia vectors are described in U.S. Pat. No. 4,722,848. BCG (Bacillus Calmette Guerin) provides another vector for expression of the disclosed antibodies (see Stover, *Nature* 351:456-460, 1991).

In one embodiment, a nucleic acid encoding the antibody or an antigen binding fragment thereof is introduced directly into cells. For example, the nucleic acid can be loaded onto gold microspheres by standard methods and introduced into the skin by a device such as Bio-Rad's Heliosa Gene Gun. The nucleic acids can be "naked," consisting of plasmids under control of a strong promoter.

Typically, the DNA is injected into muscle, although it can also be injected directly into other sites. Dosages for injection are usually around 0.5 mg/kg to about 50 mg/kg, and typically are about 0.005 mg/kg to about 5 mg/kg (see, e.g., U.S. Pat. No. 5,589,466).

A therapeutically effective amount of an HA-specific antibody or antigen binding fragment (or the nucleic acid encoding the antibody or antigen binding fragment) will depend upon the severity of the disease and/or infection and the general state of the patient's health. A therapeutically effective amount of the antibody is that which provides either subjective relief of a symptom(s) or an objectively identifiable improvement as noted by the clinician or other qualified observer. These compositions can be administered in conjunction with another therapeutic agent, either simultaneously or sequentially.

In one embodiment, administration of the antibody (or nucleic acid encoding the antibody) results in a reduction in the establishment of influenza virus infection and/or reducing subsequent disease progression in a subject. A reduction in the establishment of influenza virus infection and/or a reduction in subsequent disease progression encompass any statistically significant reduction in viral activity. In some embodiments, methods are disclosed for treating a subject with an influenza virus infection. These methods include administering to the subject a therapeutically effective amount of an antibody, or a nucleic acid encoding the antibody, thereby preventing or treating the influenza virus infection.

In additional embodiments, the subject is also administered an effective amount of an additional agent, such as anti-viral agent. The methods can include administration of one on more additional agents known in the art. For any application, the antibody, antigen binding fragment, or nucleic acid encoding the antibody or antigen binding fragment can be combined with antiretroviral therapy. Antiretroviral drugs include, but are not limited to, a neuraminidase inhibitor or an M2 protein inhibitor. Exemplary antiretroviral agents include oseltamivir, zanamivir, flutimide, rimantadine, adamantane derivatives, umifenovir, laninamivir, favipiravir, peramivir, and nitazoxanide.

Single or multiple administrations of the compositions including the antibody, antigen binding fragment, or nucleic acid encoding the antibody or antigen binding fragment, that are disclosed herein, are administered depending on the dosage and frequency as required and tolerated by the patient. In any event, the composition should provide a sufficient quantity of at least one of the antibodies disclosed herein to effectively treat the subject. The dosage can be administered once but may be applied periodically until either a therapeutic result is achieved or until side effects warrant discontinuation of therapy. In one example, a dose of the antibody is infused for thirty minutes every other day. In this example, about one to about ten doses can be administered, such as three or six doses can be administered every other day. In a further example, a continuous infusion is administered for about five to about ten days. The subject can be treated at regular intervals, such as monthly, until a desired therapeutic result is achieved. Generally, the dose is sufficient to treat or ameliorate symptoms or signs of disease without producing unacceptable toxicity to the subject.

Controlled-release parenteral formulations can be made as implants, oily injections, or as particulate systems. For a broad overview of protein delivery systems see, Banga, A. J., *Therapeutic Peptides and Proteins: Formulation, Processing, and Delivery Systems*, Technomic Publishing Company, Inc., Lancaster, Pa., (1995). Particulate systems include microspheres, microparticles, microcapsules, nanocapsules, nanospheres, and nanoparticles. Microcapsules contain the therapeutic protein, such as a cytotoxin or a drug, as a central core. In microspheres the therapeutic is dispersed throughout the particle. Particles, microspheres, and microcapsules smaller than about 1 μm are generally referred to as nanoparticles, nanospheres, and nanocapsules, respectively. Capillaries have a diameter of approximately 5 μm so that only nanoparticles are administered intravenously. Microparticles are typically around 100 μm in diameter and are administered subcutaneously or intramuscularly. See, for example, Kreuter, J., *Colloidal Drug Delivery Systems*, J. Kreuter, ed., Marcel Dekker, Inc., New York, N.Y., pp. 219-342 (1994); and Tice & Tabibi, *Treatise on Controlled Drug Delivery*, A. Kydonieus, ed., Marcel Dekker, Inc. New York, N.Y., pp. 315-339, (1992).

Polymers can be used for ion-controlled release of the antibody compositions disclosed herein. Various degradable and nondegradable polymeric matrices for use in controlled drug delivery are known in the art (Langer, *Accounts Chem. Res.* 26:537-542, 1993). For example, the block copolymer, polaxamer 407, exists as a viscous yet mobile liquid at low temperatures but forms a semisolid gel at body temperature. It has been shown to be an effective vehicle for formulation and sustained delivery of recombinant interleukin-2 and urease (Johnston et al., *Pharm. Res.* 9:425-434, 1992; and Pec et al., *J. Parent. Sci. Tech.* 44(2):58-65, 1990). Alternatively, hydroxyapatite has been used as a microcarrier for controlled release of proteins (Ijntema et al., *Int. J. Pharm.* 112:215-224, 1994). In yet another aspect, liposomes are used for controlled release as well as drug targeting of the lipid-capsulated drug (Betageri et al., *Liposome Drug Delivery Systems*, Technomic Publishing Co., Inc., Lancaster, Pa. (1993)). Numerous additional systems for controlled delivery of therapeutic proteins are known (see U.S. Pat. No. 5,055,303; U.S. Pat. No. 5,188,837; U.S. Pat. No. 4,235,871; U.S. Pat. No. 4,501,728; U.S. Pat. No. 4,837,028; U.S. Pat. No. 4,957,735; U.S. Pat. No. 5,019,369; U.S. Pat. No. 5,055,303; U.S. Pat. No. 5,514,670; U.S. Pat. No. 5,413,797; U.S. Pat. No. 5,268,164; U.S. Pat. No. 5,004,697; U.S. Pat. No. 4,902,505; U.S. Pat. No. 5,506,206; U.S. Pat. No. 5,271,961; U.S. Pat. No. 5,254,342 and U.S. Pat. No. 5,534,496).

Diagnostic Methods and Kits

A method is provided herein for the detection of the expression of HA in vitro or in vivo. In one example, expression of HA is detected in a biological sample, and can be used to detect an influenza virus infection. The sample can be any sample, including, but not limited to, tissue from biopsies, autopsies and pathology specimens. Biological samples also include sections of tissues, for example, frozen sections taken for histological purposes. Biological samples further include body fluids, such as blood, serum, plasma, sputum, spinal fluid, nasopharyngeal secretions or urine.

In one embodiment, methods are provided for determining the presence of influenza in a sample suspected of containing influenza, wherein the method includes exposing the sample to an anti-influenza antibody, and determining binding of the antibody to the influenza virus in the sample wherein binding of the antibody to the influenza virus in the sample is indicative of the presence of the influenza virus in the sample. In one embodiment, the sample is a biological sample. In another embodiment, the sample is a nasopharyngeal wash. The method can detect H1N1, H5N1, H3N2, or combinations thereof.

In several embodiments, a method is provided for detecting an influenza infection in a subject. The disclosure provides a method for detecting HA in a biological sample, wherein the method includes contacting a biological sample with the antibody under conditions conducive to the formation of an immune complex, and detecting the immune complex, to detect the HA in the biological sample. In another example, detection of HA in the sample confirms a diagnosis of an influenza infection in a subject. The method can detect H1N1, H5N1, H3N2, or combinations thereof.

In certain embodiments, the anti-influenza antibodies and compositions thereof can be used in vivo and/or in vitro for diagnosing influenza associated diseases. This can be achieved, for example, by contacting a sample to be tested, optionally along with a control sample, with the antibody under conditions that allow for formation of a complex between the antibody and influenza. Complex formation is then detected (e.g., using an ELISA). When using a control sample along with the test sample, complex is detected in both samples and any statistically significant difference in the formation of complexes between the samples is indicative of the presence of influenza in the test sample. The influenza virus can be H1N1, H5N1, H3N2, or combinations thereof.

In some embodiments, the disclosed antibodies are used to test vaccines. For example to test if a vaccine composition can induce or bind neutralizing antibodies to HA. Thus provided herein is a method for detecting testing a vaccine, wherein the method includes contacting a sample containing the vaccine, such as an HA protein, with the antibody under conditions conducive to the formation of an immune complex, and detecting the immune complex, to confirm the vaccine will be effective. In one example, the detection of the immune complex in the sample indicates that vaccine component, such as such as a HA antigen, assumes a conformation capable of inducing neutralizing antibodies, such as broadly neutralizing antibodies.

In one embodiment, the antibody is directly labeled with a detectable label. In another embodiment, the antibody that binds HA (the first antibody) is unlabeled and a second antibody or other molecule that can bind the antibody that binds HA is utilized. As is well known to one of skill in the art, a second antibody is chosen that is able to specifically bind the specific species and class of the first antibody. For example, if the first antibody is a human IgG, then the secondary antibody may be an anti-human-IgG. Other molecules that can bind to antibodies include, without limitation, Protein A and Protein G, both of which are available commercially.

Suitable labels for the antibody or secondary antibody are described above, and include various enzymes, prosthetic groups, fluorescent materials, luminescent materials, magnetic agents and radioactive materials. Non-limiting examples of suitable enzymes include horseradish peroxidase, alkaline phosphatase, beta-galactosidase, or acetylcholinesterase. Non-limiting examples of suitable prosthetic group complexes include streptavidin/biotin and avidin/biotin. Non-limiting examples of suitable fluorescent materials include umbelliferone, fluorescein, fluorescein isothiocyanate, rhodamine, dichlorotriazinylamine fluorescein, dansyl chloride or phycoerythrin. A non-limiting exemplary luminescent material is luminol; a non-limiting exemplary a magnetic agent is gadolinium, and non-limiting exemplary radioactive labels include $^{125}I$, $^{131}I$, $^{35}S$ or $^{3}H$.

The immunoassays and method disclosed herein can be used for a number of purposes. Kits for detecting an HA polypeptide will typically comprise an antibody that binds HA, such as any of the antibodies disclosed herein. In some embodiments, an antibody fragment, such as an Fv fragment or a Fab is included in the kit. In a further embodiment, the antibody is labeled (for example, with a fluorescent, radioactive, or an enzymatic label).

In one embodiment, a kit includes instructional materials disclosing means of use. The instructional materials may be written, in an electronic form (such as a computer diskette or compact disk) or may be visual (such as video files). The kits may also include additional components to facilitate the particular application for which the kit is designed. Thus, for example, the kit may additionally contain means of detecting a label (such as enzyme substrates for enzymatic labels, filter sets to detect fluorescent labels, appropriate secondary labels such as a secondary antibody, or the like). The kits may additionally include buffers and other reagents routinely used for the practice of a particular method. Such kits and appropriate contents are well known to those of skill in the art.

In one embodiment, the diagnostic kit comprises an immunoassay. Although the details of the immunoassays may vary with the particular format employed, the method of detecting HA in a biological sample generally includes the steps of contacting the biological sample with an antibody which specifically reacts, under immunologically reactive conditions, to HA. The antibody is allowed to specifically bind under immunologically reactive conditions to form an immune complex, and the presence of the immune complex (bound antibody) is detected directly or indirectly.

The following examples are provided to illustrate certain particular features and/or embodiments. These examples should not be construed to limit the disclosure to the particular features or embodiments described.

EXAMPLES

Described below is an analysis of plasmablast and monoclonal antibody responses induced by pandemic H1N1 infection in humans (see FIG. 13). Unlike antibodies elicited by annual influenza vaccinations, most neutralizing antibodies induced by pandemic H1N1 infection were broadly cross-reactive against epitopes in the hemagglutinin (HA) stalk and head domain of multiple influenza strains/subtypes. The antibodies were from cells that had undergone extensive affinity maturation. Thus, it is possible that the plasmablasts producing these broadly neutralizing antibodies were predominantly derived from activated memory B cells specific for epitopes conserved in several influenza strains. Consequentially, most neutralizing antibodies were broadly reactive against divergent H1N1 and H5N1 influenza strains. Certain of the antibodies generated potently protected and rescued mice from lethal challenge with pandemic H1N1 or antigenically distinct influenza strains.

Described below are studies in which the B cell responses in 24 healthy adult volunteers immunized with the monovalent subunit pandemic H1N1 2009 vaccine were studied. In all cases a rapid, predominantly IgG-producing plasmablast response was found. These plasmablasts were isolated and monoclonal antibodies were generated by single-cell PCR. Over half (45/78) were virus-specific and 62% (28/45) bound to the pandemic 2009 HA. Strikingly, the majority of these antibodies (25/28) neutralized more than one influenza strain and exhibited high levels of somatic hypermutation, suggesting they were derived from recall of B cell memory. Indeed, memory B cells that recognized the pandemic H1N1 HA were detectable prior to vaccination not only in this cohort but also in stored samples obtained prior to the emergence of the pandemic strain. Three antibodies demonstrated extremely broad cross-reactivity and were found to bind the HA stem. Furthermore, one of them was found to recognize not only H1 and H5 but also H3 influenza viruses. This exceptional cross-reactivity indicates that antibodies capable of neutralizing most influenza subtypes might indeed be elicited by vaccination. These antibodies can be used to design influenza vaccines that can elicit these broadly cross-reactive antibodies at sufficiently high levels to provide heterosubtypic protection.

Example 1

Monovalent Pandemic H1N1 2009 Vaccine Induces Rapid Expansion of Antigen-Specific Plasmablasts Humoral immune responses in 24 healthy adult volunteers immunized with the monovalent pandemic H1N1 2009 vaccine was examined (FIG. 1). Subjects entered the study approximately 6 months after the first reports of pandemic H1N1 2009 cases. The vaccine administered contained the HA subunit from the pandemic influenza A/California/04/09 and was given separately after the 2009 seasonal influenza vaccine which contained a different H1N1 strain (A/Brisbane/59/07) as well as H3N2 and influenza B strains. Seventeen individuals (71%) receiving pandemic H1N1 2009 vaccine demonstrated an increase in hemagglutination inhibition (HAI) titer at 28 days post-vaccination (accepted as at least a 4-fold increase in HAI titer) (FIG. 1*a*). Eighteen individuals (75%) exhibited HAI titers conventionally considered protective (1:40) at day 28. Seroconversion rates were comparable to those seen with seasonal influenza vaccination (Hancock et al., 2009, *N Engl J Med* 361(20):1945-1952).

An earlier study using seasonal TIV demonstrated that seroconversion is associated with a large, transient expansion of antibody-secreting cells (plasmablasts) in the blood (Wrammert et al., 2008, *Nature* 453(7195):667-671). The current study quantified the plasmablast response to pandemic H1N1 2009 vaccine in PBMCs at day 0, 7, 14 and 30 post-vaccination by ELISPOT using this approach. The vaccine-specific plasmablast response was found to peak at day 7 before returning to background levels by day 14 (FIG. 1*b*). These kinetics were the same as those seen in controls who were given the 2008/09 TIV, which contained components from influenza A/Brisbane/59/07 H1N1, A/Brisbane 10/07 (H3N2) and B/Florida/4/06 (FIG. 7). Following immunization with the pandemic H1N1 2009 vaccine, there was a positive correlation between the increases in HAI titer and peak plasmablast numbers ($r^2$=0.53, p<0.0001) (FIG. 1*c*). The rapidity of the plasmablast response strongly suggested a recall rather than primary response. Indeed, IgG-producing cells greatly outnumbered IgM-producing cells (p=0.0483, mean+/−SEM: 520+/−254 SFU/$10^6$ vs. 5.36+/−1.48 SFU/$10^6$). This was also seen in the response to 2008/09 TIV (p=0.0066, 535.8+/−154 SFU/$10^6$ vs. 63.3+/−50.0 SFU/$10^6$), a known recall response (FIG. 1*d*). Together, these data show that the B cell responses induced by seasonal TIV and the pandemic H1N1 2009 vaccine were similar in terms of speed and isotype, suggesting that both are due to memory recall.

Example 2

Plasmablasts Induced by the Monovalent H1N1 2009 Vaccine Cross-React with the 2009/10 Seasonal Vaccine Since features of the plasmablast response to the pandemic H1N1 2009 vaccine were suggestive of memory recall, the extent to which plasmablasts could also be induced that were reactive against the seasonal influenza strain from the previous two years found in the 2009/10 TW (A/Brisbane/59/07) was examined. The HA of the pandemic H1N1 2009 strain diverged considerably from that of influenza A/Brisbane/59/07 with only 79% sequence homology (FIG. 8). Despite this, most individuals, after vaccination with the pandemic H1N1 2009 vaccine, generated a large number of plasmablasts that reacted with the 2009/10 TIV (FIG. 9*a*). In order to enrich for plasmablasts, next these cells by flow were sorted by cytometry from 10 individuals at day 7 (FIG. 9*b*). A high proportion of sorted plasmablasts were antigen-specific (representative donor in FIG. 9*c*). This was similar to previous findings with seasonal influenza vaccination (Wrammert, 2008, supra). In addition, plasmablasts with specificity for A/Brisbane/59/07 HA as well as pandemic H1N1 2009 HA were detected in all sorted samples (FIG. 9*d*). Thus, the bulk of the humoral response to vaccination was against HA and that the pandemic H1N1 2009 vaccine induced a plasmablast response against both the homologous antigen and a heterologous antigen from the seasonal influenza strain of the preceding two years.

Example 3

The Pandemic H1N1 2009 Vaccine can Induce Antibodies that Bind the HA Stem

Figures 2A, 2B, 2C, 2D:
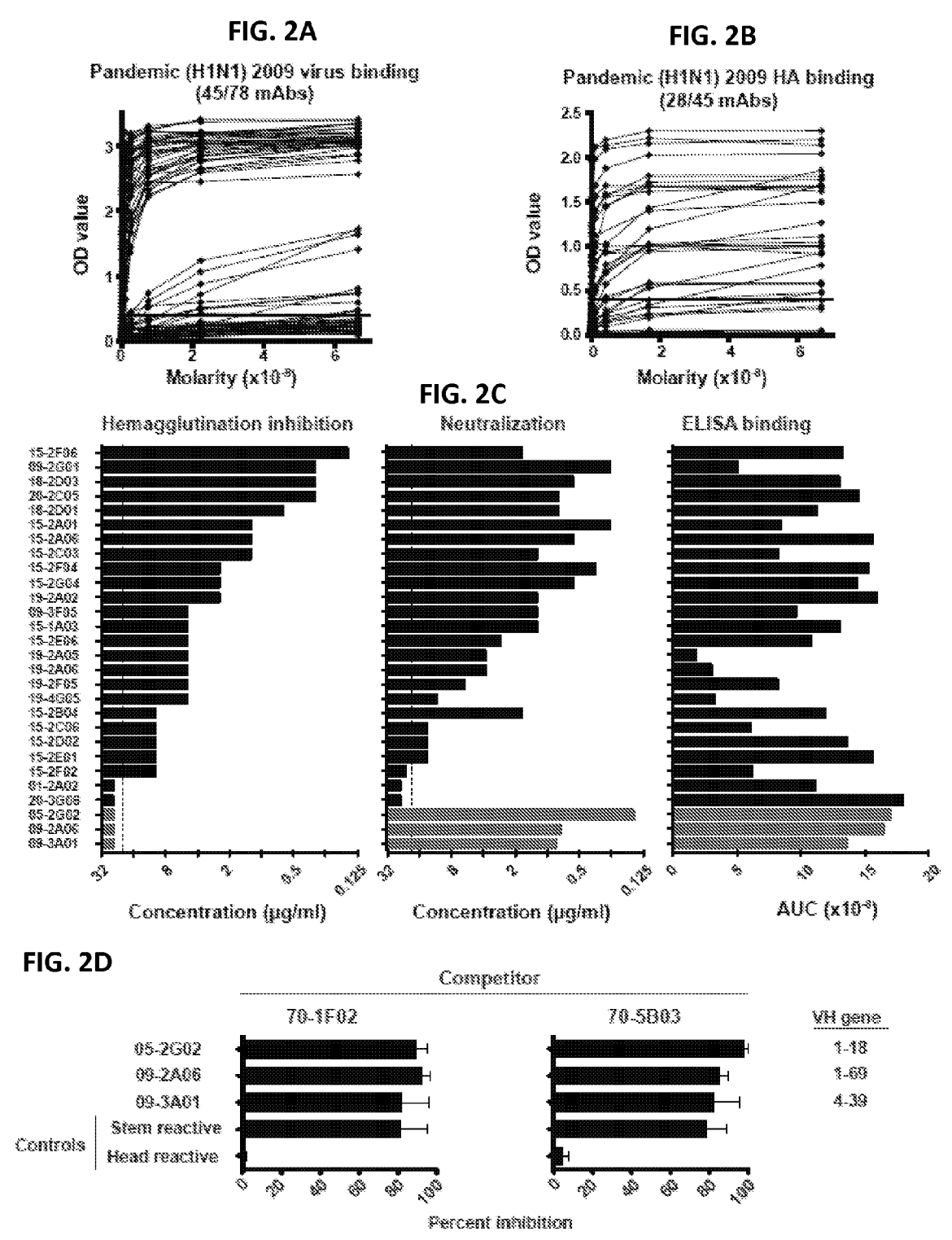

To examine the specificities of the antibody response to pandemic H1N1 2009 vaccine at the monoclonal level, single-cell RT-PCR of sorted individual plasmablasts was used to produce mAbs as previously described (Wrammert et 1., 2009, supra; Smith et al., 2009, *Nat Protoc* 4(3):372-384.). The advantage of this method lies in the ability to generate mAbs from B cells that are proliferating acutely in response to vaccination as opposed to resting memory B cells. Furthermore, bias is reduced by analyzing the whole vaccine-induced plasmablast response without preferentially selecting for particular sub-populations using an antigen bait. In total, 78 mAbs from 8 subjects were generated. By ELISA, 58% (45/78) bound to purified pandemic H1N1 2009 virus (FIG. 2*a*). Of these, 62% (28/45) bound to recombinant HA from the pandemic strain.

As ELISA is only capable of demonstrating binding of the antibody to antigen, functional assays were used to characterize HA-specific mAbs. The hemagglutination inhibition assay (HAI) measures the concentration of antibody required to inhibit the agglutination of red blood cells by the virus and is indicative of the capacity of the antibody to prevent viral attachment to cells. In contrast, neutralization assays show how effectively the antibody prevents viral infectivity by measuring the concentration required to block lytic infection of cultured cells. Out of the mAbs that demonstrated HA-specific binding, 89% (25/28) were shown to have functional activity against pandemic H1N1 2009 virus by HAI and/or neutralization assay (FIG. 2*b*).

It was previously shown that mAbs recognizing epitopes in the globular head of the influenza HA demonstrated binding by ELISA, positive HAI and neutralization of infectivity (Wrammert et al., 2011, J. Exp. Med. 208(1): 181-193, 2011). In contrast, stem-binding mAbs showed binding by ELISA and neutralization, but negative HAI. In this set of mAbs, while there was generally good correlation between HAI and neutralization activities, three mAbs (05-2G02, 09-2A06 and 09-3A01) were found to have no HAI activity despite binding by ELISA and neutralization, a pattern suggestive of stem-binding mAbs. In order to confirm their HA binding site, their binding was compared with known stem-binding antibodies by competition ELISA (FIG. 2c). ELISA plates coated with influenza A/California/04/09 HA were pre-incubated with one of two known stem-binding mAbs (70-1F02 or 70-5B03) (Wrammert et al, 2011, supra). The putative stem-bind mAbs were biotinylated and added, according to a standard ELISA protocol, to either pre-incubated or non-pre-incubated plates. The amount of antibody binding in each plate was determined and percentage inhibition of each mAb was subsequently calculated using the ratio of binding in the pre-incubated plates to binding in non-pre-incubated plates.

Whether in competition with the previously described 70-1F02 or 70-5B03, all 3 potential stem-binding mAbs were inhibited by greater than 80%, which was comparable to the stem-binding mAbs used as positive controls (the reciprocal antibody of either 70-1F02 or 70-5B03 depending on which was used to pre-incubate). This contrasted with a previously described negative control (EM4C04), which was highly specific to pandemic H1N1 2009 HA and mapped to an epitope in the head region (Wrammert et al., 2011, supra). Thus, by competition ELISA, it was demonstrated that the mAbs 05-2G02, 09-2A06 and 09-3A01 all compete for binding to an epitope in the HA stem. The three stem-binding mAbs all used different $V_H$ gene segments (FIG. 2c & FIG. 14), compared with the pandemic H1N1 2009 infection where the majority of mAbs induced by the infection used the $V_H1$-69 gene segment, also shared by other reported stem-binding antibodies (Ekiert et al., 2009; Science 324(5924):246-251; Sui et al., 2009, Nat Struct Mol Biol 16(3):265-273). Here, only one mAb used the $V_H1$-69, although a second used the highly similar $V_H1$-18. Together our data suggest that stem-reactive antibodies can indeed be elicited by the pandemic H1N1 2009 vaccine, but occur at a lower frequency.

Example 4

Monoclonal Antibodies Elicited by Pandemic H1N1 2009 Vaccine Cross-React with Antigenically Divergent Strains All HA-specific mAbs were tested for binding, HAI and neutralization capacity against a panel of antigens and virus strains, including antigenically similar strains such as the pandemic H1N1 1918 strain and antigenically diverse H1N1, H5N1 and H3N2 strains. Strikingly, the majority of mAbs that bound the HA head also demonstrated broad cross-reactivity (FIG. 3a) with three-quarters binding to both A/Brisbane/59/07 HA and 1918 HA. The majority (18 of 28) were able to bind all 3 H1N1 HAs whilst 6 out of 28 bound both pandemic H1N1 2009 and 1918 influenza HAs, in a similar manner to several antibodies previously described (Wrammert et al., 2011, supra; Xu et al., 2010, Science 328(5976): 357-360). The high degree of cross-reactivity suggested that many of these plasmablasts had arisen by secondary expansion of cross-reactive memory B cells that presumably targeted conserved epitopes. Comparing the binding of these antibodies to the most recent seasonal H1N1 strain in circulation prior to the emergence of the pandemic, A/Brisbane/59/07, the patterns of cross-reactivity generally conform to three categories (FIG. 10). Most (14/28) of the antibodies bound better to the pandemic H1N1 HA, suggesting ongoing adaptation through affinity maturation. Other antibodies bound equally well to both HAs (9/28) while the last category (5/28) bound better to the Brisbane HA, consistent with OAS (original antigenic sin).

Figure 8:
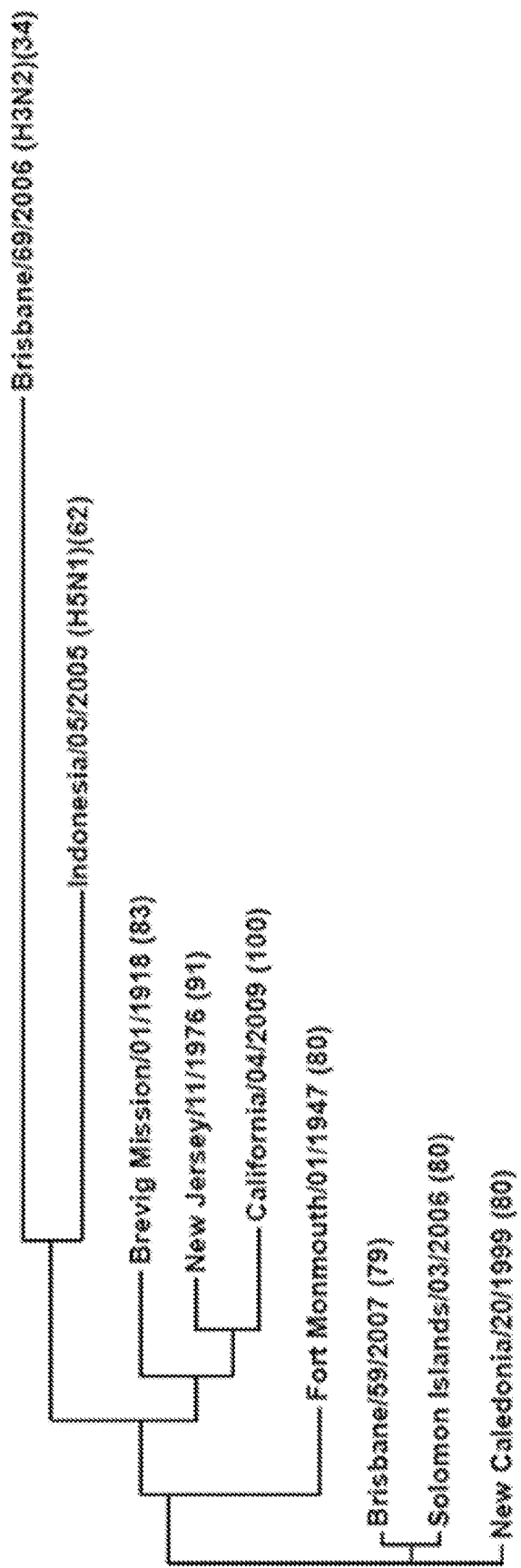
FIG. 8. Sequence homology of HAs from H1N1 strains. HA sequences were obtained from GENBANK® (ncbi.nlm.nih.gov/protein/). Sequences were aligned using ClustalW2 and displayed as a phylogenetic tree. Numbers in brackets represent pairwise alignment scores. Correlation analysis was done using Spearman's rank correlation and comparison between groups using Student's t-test.
Figure 9A:
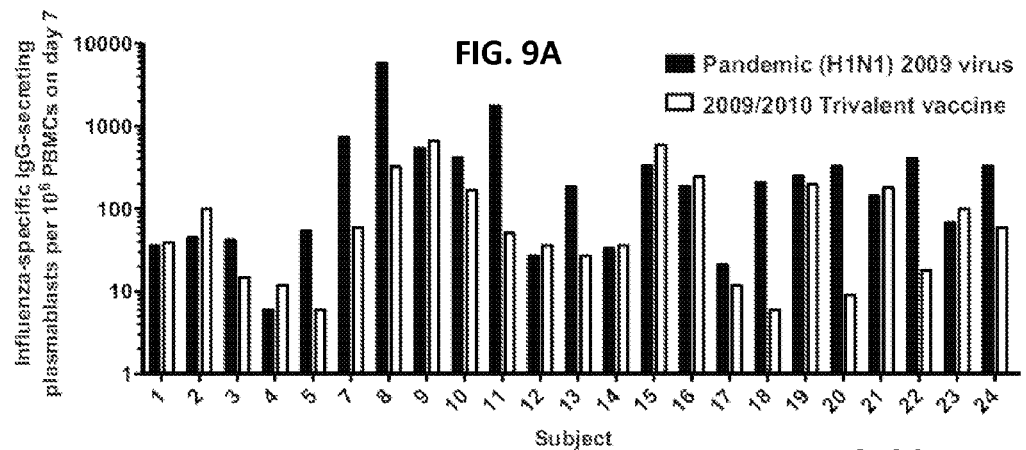
FIGS. 9A-9D. Plasmablasts induced by the monovalent (H1N1) 2009 vaccine cross-react with the 2009/10 seasonal TIV. Healthy adult volunteers were vaccinated with pandemic (H1N1) 2009 vaccine. (A) The numbers of IgG-producing plasmablasts in day 7 PBMCs that reacted against pandemic (H1N1) 2009 virus or the 2009/10 TIV (which contained the A/Brisbane/59/07 H1N1 strain) were determined by ELISPOT. (B) Example of plasmablast isolation by flow cytometry. (C) Representative ELISPOT images showing total IgG-producing plasmablasts and those reactive against indicated HA proteins. (D) ELISPOT scoring of sorted plasmablasts reactive against HA derived from the indicated viruses. ELISPOT for 1 donor is not shown due to insufficient plasmablast numbers post-sort.
Figure 9B:
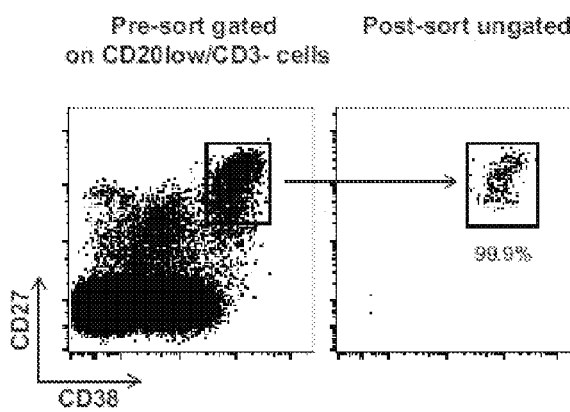
Figure 9C:
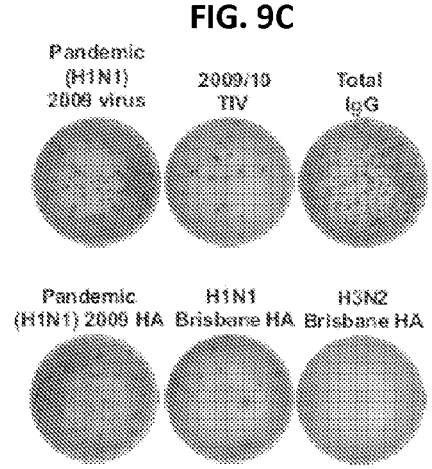
Figure 9D:
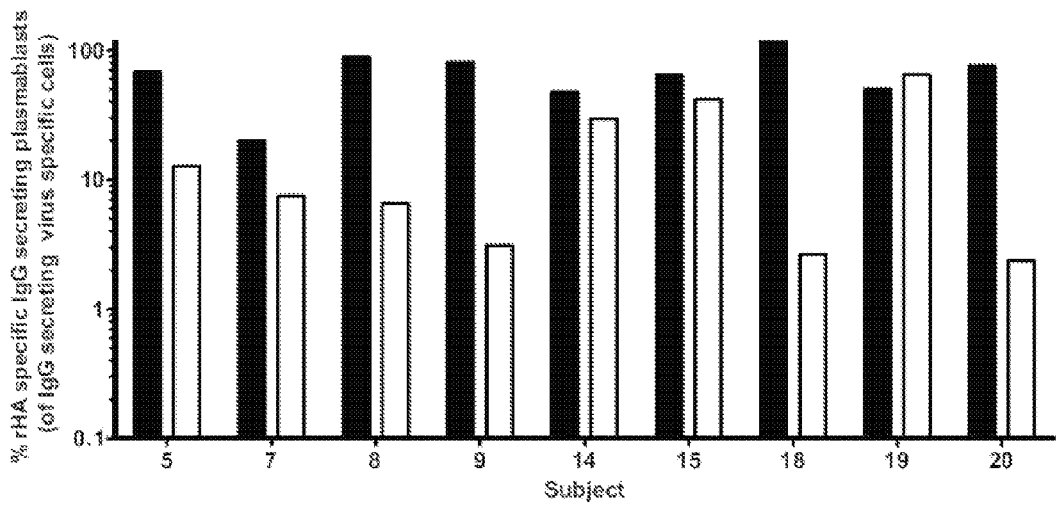
Figure 11:
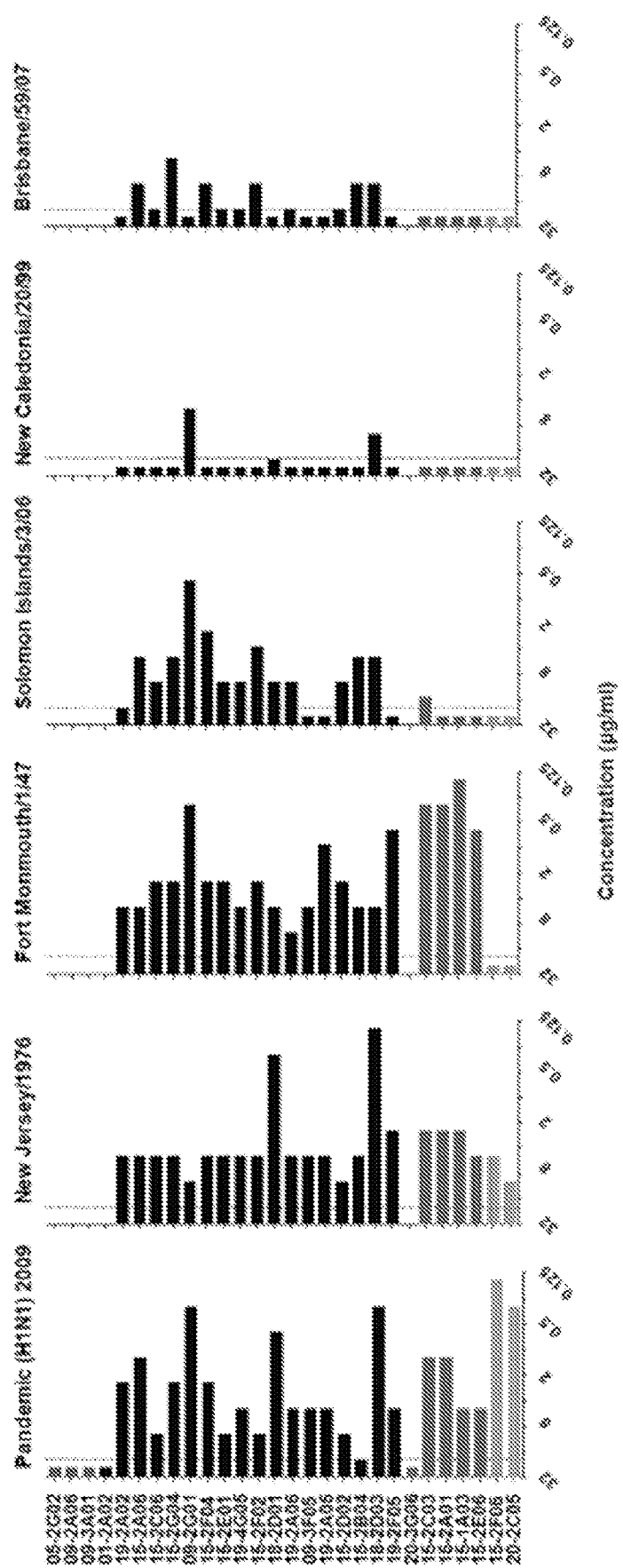
FIG. 11. Cross-reactivity of HA-specific monoclonal antibodies by HAI. Twenty-eight pandemic (H1N1) HA-binding mAbs were tested for neutralizing activity against a panel of H1N1 virus strains. Influenza strains are arranged in order of sequence similarity to the pandemic (H1N1) 2009 and mAbs are arranged according to cross-reactivity and degree of binding to pandemic (H1N1) 2009 HA. Dotted lines represent limits of detection. Data are representative of 2-4 repeat experiments.

Next, HAI and neutralization assays were performed using a more extensive panel of H1N1 virus strains including recent seasonal strains (A/Brisbane/10/07, A/Solomon Islands/3/06 and A/New Caledonia/20/99) and historic outbreak strains (A/New Jersey/76 and A/Fort Monmouth/1/47) (FIG. 3b & FIG. 11), which displayed a broad range of sequence divergence compared to the pandemic H1N1 2009 virus. As expected from sequence homology (FIG. 8), the highest degree of cross-reactivity by neutralization assay was seen with A/New Jersey/76, with 68% of mAbs cross-neutralizing. Of the more recent seasonal strains, up to 43% of mAbs demonstrated cross-reactivity between the seasonal strains and pandemic H1N1 2009 virus. In general, the fraction of cross-neutralizing antibodies paralleled sequence homology. Still, given the large antigenic differences measured by standard reference sera, the fraction of cross-neutralizing antibodies was much larger than expected.

Figure 3B:
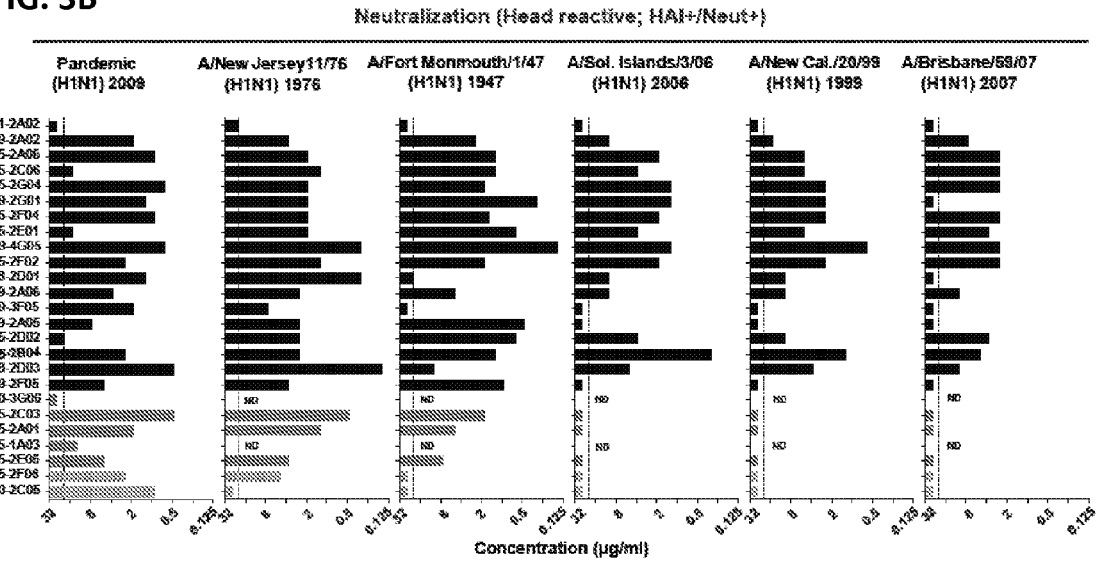
Figure 3C:
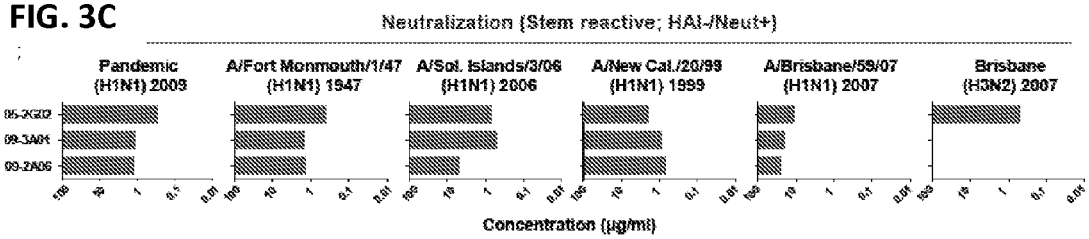

The three stem-binding mAbs demonstrated the widest cross-reactivity by ELISA with detectable binding to all the H1 HAs tested plus HA from the H5N1 strain (A/Indonesia/05/2005) (FIG. 3a). Furthermore, 05-2G02 displayed even greater cross-reactivity by also binding H3, albeit weakly. Their ability to neutralize both H1N1 and H3N2 strains were tested (FIG. 3c). Once again, all three stem-binding mAbs demonstrated broad cross-reactivity with the capacity to neutralize all H1N1 strains tested. In addition, the exceptional breadth of 05-2G02 was again shown, with neutralizing activity against H3N2 as well as the H1N1 strains. Antibodies that neutralize influenza strains from both phylogenetic group 1 and group 2 are exceedingly rare and have only been reported once in the literature (Corti et al., 2011, Science 333: 850-856). These data demonstrate the high degree of cross-reactivity of mAbs generated following pandemic H1N1 2009 vaccination. This is true not only of the stem-reactive mAbs, one of which had unusually broad cross-reactivity against H1, H5 and H3, but also of the majority of non-stem-binding mAbs, which demonstrated substantial cross-reactivity within H1N1 strains in contrast to the more strain-specific mAbs generated following seasonal TIV (Wrammert et al., 2008, supra).

Example 5

Pandemic H1N1 2009 Vaccine Induces Monoclonal Antibodies with High Levels of Somatic Hypermutation Together, the kinetics of the response, the dominance of IgG-secreting cells and the remarkable cross-reactivity of individual plasmablasts point to a memory origin for most clones. This was further supported by sequence analysis of virus-specific mAbs (FIG. 4a). When the somatic mutations per $V_H$ gene were calculated, the majority of clones showed an exceptionally high number of mutations (median 21 range 8-41). This was significantly higher (p<0.0001) than the average IgG-producing memory B cell or germinal center B cell (median 11 range 1-35) but similar to the number found following the recall of the memory B cell response by the seasonal influenza vaccination (median 18.5 range 6-51). These were also similar to the results of a previous study of mAbs from patients infected with the pandemic H1N1 2009 virus, where high levels of somatic hypermutation were observed. When the HA-specific mAbs were analyzed alone (FIG. 4b), they displayed similar levels of mutation compared to the virus-specific mAbs as a whole. Furthermore, there was no obvious correlation between the number of mutations and the degree of cross-reactivity of each individual mAb (FIG. 3).

Example 6

Figure 5B:
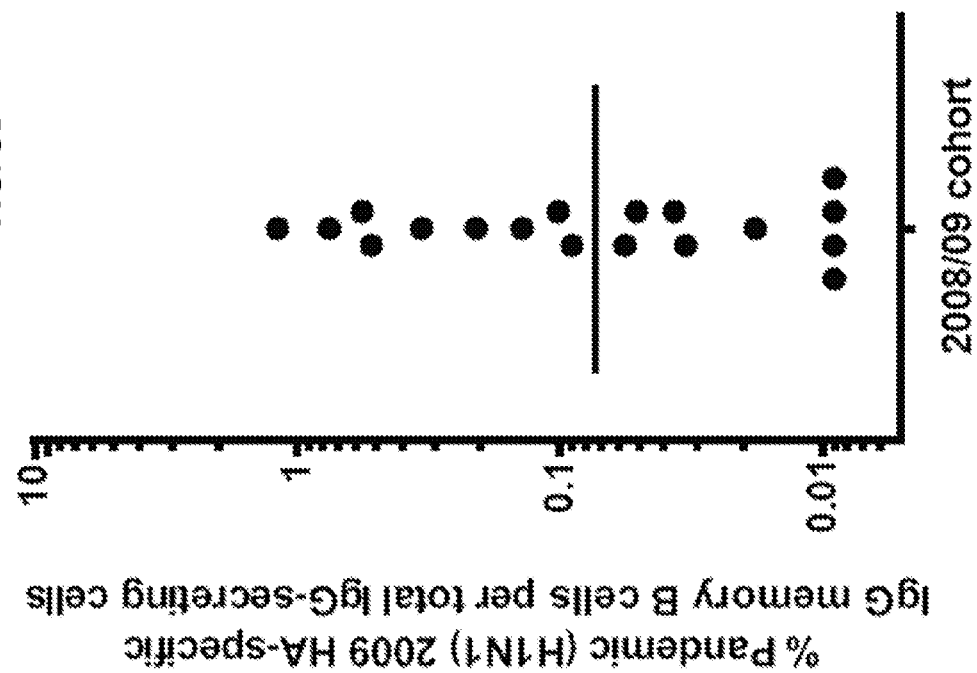
FIGS. 5A-5B. Memory B cells reactive to the pandemic H1N1 2009 influenza are detectable even prior to the emergence of the pandemic strain. PBMCs obtained prior to vaccination were tested for the presence of memory B cells reactive against the pandemic H1N1 2009 HA by polyclonal activation followed by detection using ELISPOT. The percentage of IgG-secreting memory B cells compared with total IgG-secreting cells is shown in subjects from (A) the year that the pandemic H1N1 2009 emerged (2009/10) and (B) the previous year (2008/09).
Figure 5A:
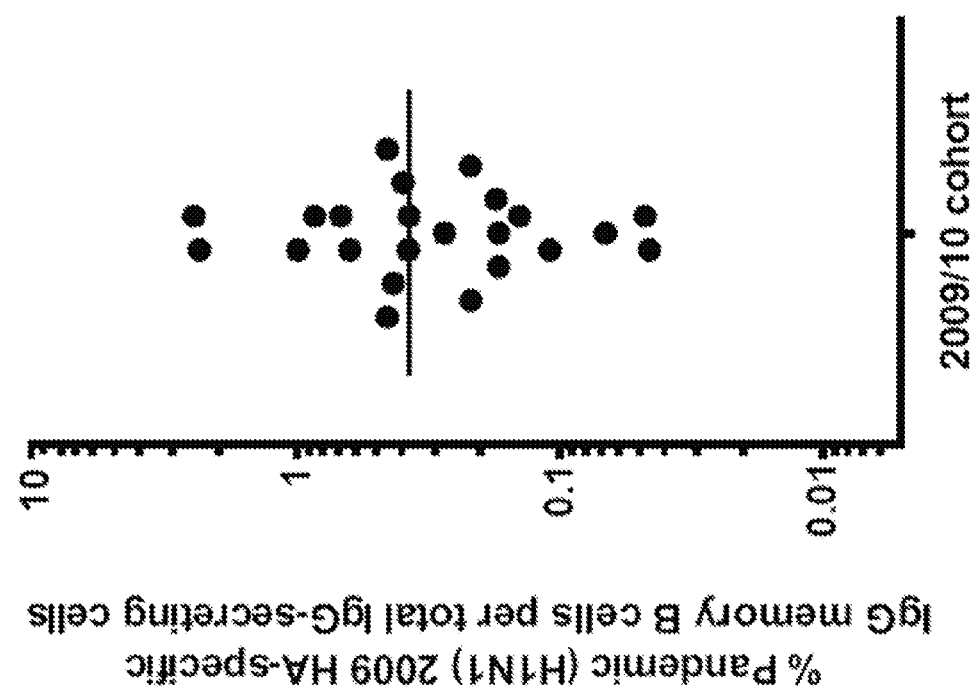

Presence of Memory B Cells Reactive to the Pandemic Strain Present Prior to its Emergence It appeared possible that cross-reactive memory B cells capable of reacting to the pandemic H1N1 2009 vaccine were already present prior to vaccination. Thus, samples from pre-vaccination subjects were analyzed with a memory B cell assay (Crotty et al., *J Immunol Methods* 286(1-2):111-122, 2004) (FIG. 5*a*). Using this technique, all subjects had detectable memory B cells reactive against pandemic H1N1 2009 HA prior to vaccination (median 0.4%, range 0.013%-1.98%). However, subclinical infections with influenza that induce seroconversion without symptoms do occur and go unreported (Papenburg, *Clin Infect Dis* 51(9):1033-1041, 2010). It was therefore possible that vaccinees had been exposed to the pandemic H1N1 2009 virus at some point between its emergence and their vaccination. In order to exclude this possibility, baseline samples were retrieved from a different healthy cohort taken in 2008/09 before the emergence of the novel pandemic strain (FIG. 5*b*). Once again the majority of these specimens contained detectable memory B cells which reacted against the pandemic H1N1 2009 HA. In summary, these data show that the pandemic H1N1 2009 vaccine preferentially activates cross-reactive memory B cells generated by encounters with HA from previous influenza strains, including broadly cross-reactive stem-specific Abs with neutralizing activity.

Following infection with pandemic H1N1 2009 influenza virus, an earlier study showed that the humoral response was dominated by antibodies that bound to the conserved stem of HA and neutralized multiple influenza subtypes (Wrammet et al., 2008, supra). A vaccine that could induce these antibodies might provide heterosubtypic protection but seasonal influenza vaccines had not been shown to induce them (Hancock, 2009, supra; Wrammert et al., 2008, supra). The question therefore remained as to whether broadly cross-reactive stem-binding antibodies could, in fact, be generated following influenza vaccination. The current studies have shown that these antibodies could be induced by the monovalent inactivated pandemic H1N1 2009 vaccine. Healthy adults were vaccinated with the pandemic H1N1 2009 vaccine and mAbs generated from plasmablasts isolated at the peak of the response. These data suggest that, like the seasonal TIV, the pandemic vaccine induced an antibody response by stimulation of pre-existing memory B cells. However, in contrast to the seasonal vaccine, mAbs induced by the pandemic H1N1 2009 vaccine displayed striking cross-reactivity. Furthermore, although they were less frequent than with infection, stem-binding mAbs could readily be detected and one was even capable of neutralizing both H1N1 (phylogenetic group 1) and H3N2 (group 2) strains.

The approach used here for the cloning of mAbs from plasmablasts has two major advantages. Firstly, these were influenza-specific B cells proliferating in response to the challenge of a specific vaccine and not just resting memory B cells, which consist of a range of clones generated by a variety of previous antigenic challenges. Since plasmablasts generated in response to vaccine disappear within 14 days, those induced by seasonal influenza vaccine administered several weeks previously would not have directly contributed to the plasmablasts that were analyzed. Memory B cells against the HAs of seasonal strains may have been boosted by seasonal vaccination but would not have fundamentally changed in terms of repertoire. Secondly, while other techniques use antigen to preferentially enrich for B cells with the specificities of interest, analysis of all the proliferating plasmablasts allowed examination of the repertoire of influenza-specific antibodies with minimal bias. Using these techniques, the current studies showed that the B cell responses to the pandemic H1N1 2009 and seasonal vaccines were comparable in many ways (Wrammert et al., 2008, supra). Both vaccines induced large and rapid plasmablast responses with similar magnitudes and kinetics. In addition, both responses were predominantly made up of isotype switched IgG-producing plasmablasts and mAbs generated from these plasmablasts showed evidence of extensive somatic hypermutation. These features characterize a secondary response (Schittek and Rawjewsky, 1990, *Nature* 346(6286):749-751; McHeyzer-Williams et al., 1991, *Nature* 350(6318):502-505; and Aprin et al., 1997, *J Exp Med* 186(6):931-940) and imply that the response to the pandemic H1N1 2009 vaccine is derived from pre-existing memory B cells in a similar fashion to the seasonal vaccine. This was conclusively demonstrated by the presence of memory B cells specific for pandemic H1N1 2009 HA in individuals even prior to the emergence of the new virus, strongly implying they were induced by exposure to previous seasonal strains.

However, the antibody response to pandemic H1N1 2009 vaccine clearly differed in one important respect: the high degree of cross-reactivity. Unlike previous studies of seasonal TIV (Hancock et al., 2009, supra; Wrammert et al., 2008, supra), the current data suggest that cross-reactive antibodies against both the head and stem of HA were readily induced by the pandemic H1N1 2009 vaccine and made up a large proportion of the response. Cross-reactive antibodies against both the head and stem of HA from the seasonal TIV have been described in humans using a number of systems (Thorsby et al., 2008 *PLoS One* 3(12):e3942; Ekiert et al., 2009, *Science* 324(5924):246-251; Sui et al, 2009, *Nat Struct Mol Biol* 16(3):265-273; Cori et al., 2010, *J Clin Invest* 120 (5):1663-1673). However, the antibodies that were identified previously were not effective. While different stem-binding antibodies have been identified following vaccination, these have primarily relied upon phage display libraries (Thorsby et al., 2008, supra; Ekiert et al., 2009, supra; Sui et al, 2009, supra) and immortalization of memory B cells (Corti et al, 2010, supra). A recent study has shown that the MF59 adjuvant can enhance the diversity and affinity of the antibody response to pandemic influenza vaccine (Khurana, 2011, *Sci Transl Med* 3(85):85ra48).

The majority of the cross-reactive mAbs here were directed against the globular head of HA. However, three stem-binding mAbs were identified and shown to be broadly cross-reactive. One of them, 05-2G02, demonstrated an extraordinary breadth of neutralizing activity, with activity against all H1N1 strains tested as well as binding to H5N1 HA and neutralization of a H3N2 strain. The capacity to recognize HAs from both phylogenetic groups does not appear to be dependent on a unique antigen-binding structure. The antibodies provide important proof of concept that a universal vaccine capable of stimulating antibodies that neutralize all influenza subtypes.

It is also clear that cross-reactive stem-binding antibodies are very rare after vaccination with seasonal strains. Studies that have found stem-binding memory B cell clones have required high throughput techniques to screen large numbers of cells (Corte et al., 2006, supra). In the work disclosed herein, stem-reactive antibodies were readily found with 3 out of 28 HA-specific mAbs generated from 8 vaccinees showing stem-reactivity. This implies that the pandemic H1N1 2009 vaccine induces these antibodies more frequently as a consequence of the major change in epitopes from the HA head while the stem remains relatively conserved. In addition, while 2 stem-specific mAbs came from one subject and one from another, several subjects had none, suggesting that some individuals might have a stronger propensity for developing cross-reactive antibodies by nature of their underlying B cell repertoire and their previous antigenic history. In animal models, sequential immunization with different HAs can preferentially stimulate broadly cross-reactive antibodies (Wang et al, 2010, *PLoS Pathog* 6(2):e1000796), a phenomenon recapitulated in nature with the emergence of a pandemic strain.

The low frequency of broadly cross-reactive stem-binding antibodies following the pandemic H1N1 2009 vaccine contrasts with the antibody responses seen following natural infection. Earlier studies demonstrated that broadly cross-reactive antibodies that bound to the HA stem region dominated the humoral response in patients infected with pandemic H1N1 2009, with as many as half of these neutralizing mAbs recognizing the same epitope (Wrammert et al., 2008, supra). These stem-binding mAbs shared a common $V_H$ gene rearrangement which was not observed following vaccination. Immunization with the subunit pandemic H1N1 2009 vaccine, which primarily consists of HA and NA, induces a quantitatively and qualitatively different immune response. Specifically, subunit vaccines cannot infect cells, therefore preferentially utilizing extrinsic antigen presentation pathways as well as inducing less potent inflammatory and innate responses. Infection also results in greater antigen load and duration, leading to increased recruitment of precursors and signals for differentiation.

Figure 6:
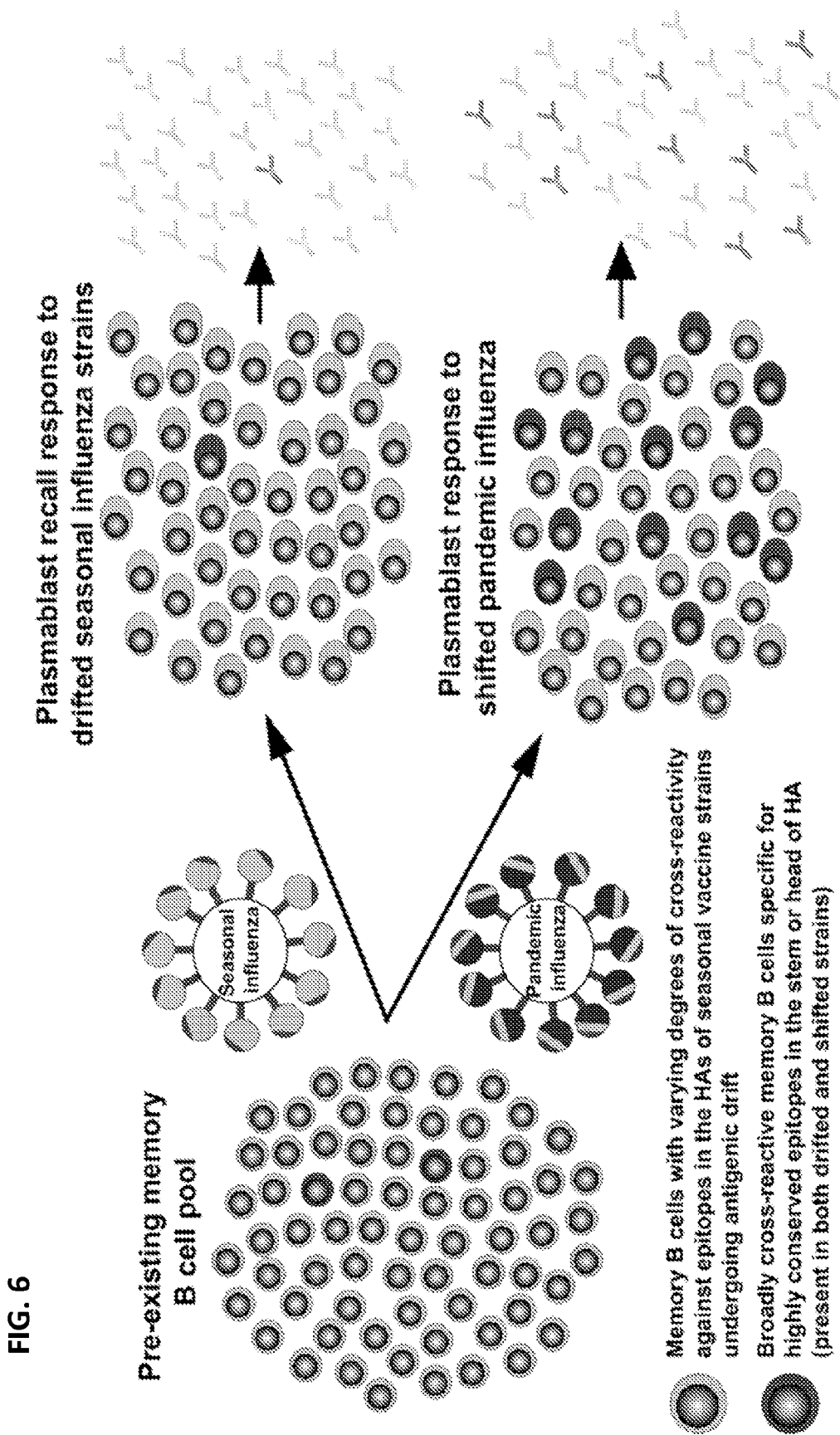
FIG. 6. A model contrasting the antibody response induced after vaccination with seasonal versus pandemic influenza vaccines. The pre-existing influenza-specific B cell pool primarily consists of memory cells that recognize epitopes in the globular head of HA from recent seasonal strains that undergo antigenic drift and thus change relatively little year to year (shown in green). These are highly expanded due to recurrent stimulation over several winter seasons while memory B cells specific for epitopes in the stem of HA (shown in red) are crowded out. Following an infection or vaccination with drifted seasonal influenza strains, the large numbers of immunodominant head-reactive memory B cells undergo re-expansion while those against conserved epitopes cannot compete. In a pandemic strain, many epitopes in the HA head are replaced while conserved epitopes in the stem and head remain. Cross-reactive memory B cells specific for the conserved epitopes now have a greater chance of being recruited into the response.
Figure 7:
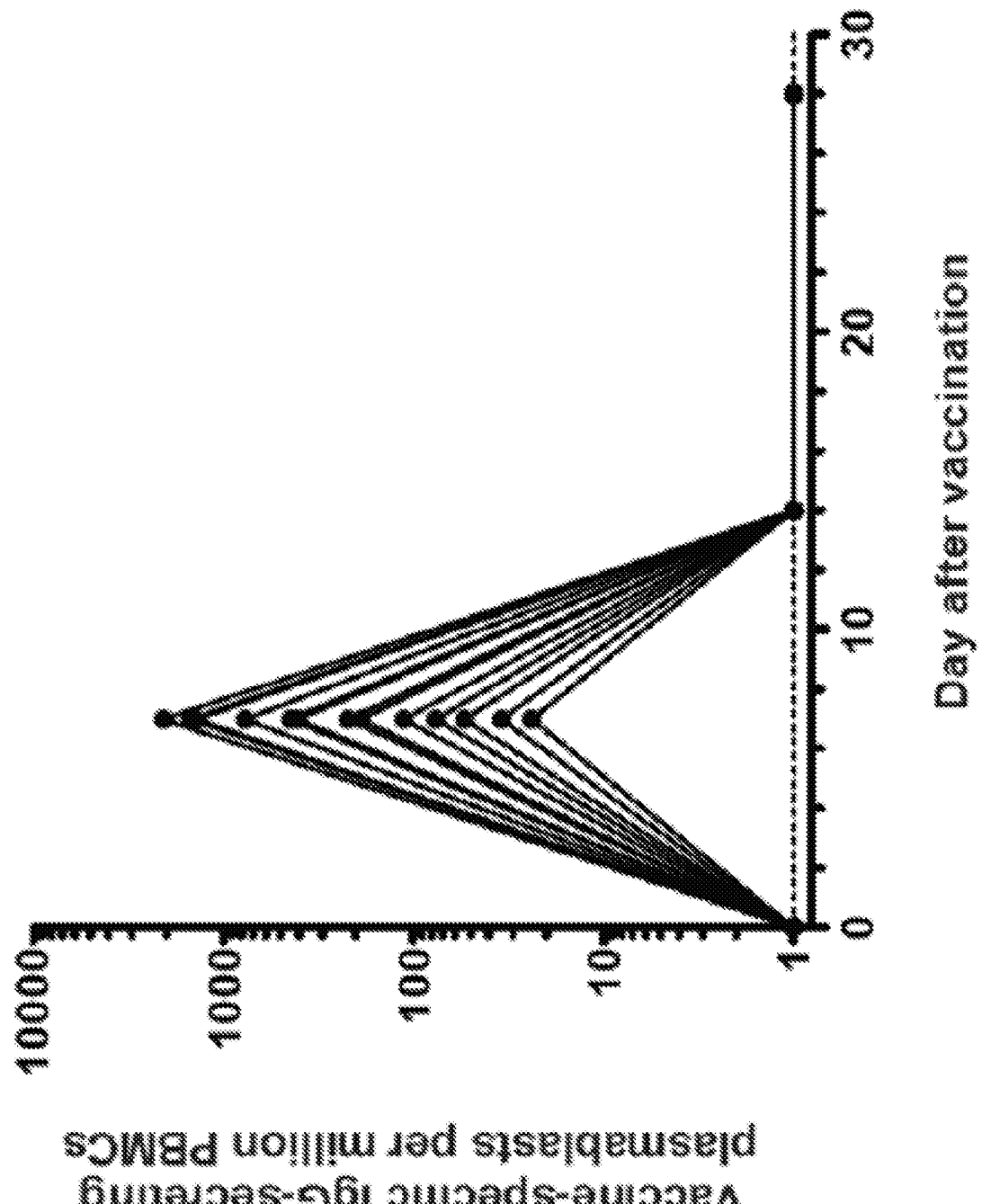
FIG. 7. The 2008/09 trivalent inactivated influenza vaccine induces a rapid plasmablast response. Healthy adult volunteers were vaccinated with the 2008/09 TIV. PBMCs were taken at 0, 7, 14 and 28 days post-vaccination and the number of vaccine-specific IgG-producing plasmablasts were determined by ELISPOT. Dotted lines represent the limits of detection for each assay.

Unlike the humoral response to the seasonal vaccine, cross-reactive clones against the pandemic H1N1 2009 vaccine could be readily detected from acutely responding plasmablasts. The current studies also showed that they were derived from memory B cells that recognized conserved epitopes across virus strains. Thus, it might be that broadly cross-reactive antibodies are produced by low-frequency memory B cells reactive against conserved but subdominant epitopes (FIG. 6). In the context of seasonal influenza, these are not recruited into the response, remaining relatively quiescent due to competition by the more numerous B cells specific for immunodominant epitopes exposed in the globular HA head. However, following a major change in the HA, most of these immunodominant epitopes are replaced with novel structures. With their disappearance, cross-reactive memory B cells against conserved epitopes in both the head and stem no longer need to compete with memory cells specific for the previous strains. Thus, cross-reactive antibodies make up a greater proportion of the humoral immune response following antigenic shift.

This also offers an explanation as to why the preceding seasonal H1N1 strain almost completely disappeared following the emergence of the pandemic H1N1 2009 virus (Palese P & Wang T T (2011), *MBio* 2(5)). The current studies in individuals infected or vaccinated with pandemic H1N1 2009 have shown that in either situation large numbers of cross-reactive antibodies with activity against A/Brisbane/59/07 are generated (Wrammert et al, 2008, supra). Thus, most individuals who have encountered the pandemic H1N1 2009 strain will also have developed protective immunity against A/Brisbane/59/07 leading to a rapid decrease in the number of susceptible hosts.

The data herein show that broadly cross-reactive stem-binding antibodies can be induced by the pandemic H1N1 2009 vaccine, thus demonstrating that productive infection is not required. Furthermore, stem-binding antibodies with the capacity to neutralize a broad range of influenza subtypes can be induced by vaccination. However, the frequency of these stem-binding antibodies following the pandemic H1N1 2009 vaccine was low and not all vaccinees were found to generate them. In order for a truly universal vaccine to be effective, it must induce cross-reactive antibodies to a high level in all recipients to provide robust heterosubtypic immunity.

Example 7

Detailed Information Regarding Antibodies that Bind Influenza Virus

Figure 14A:
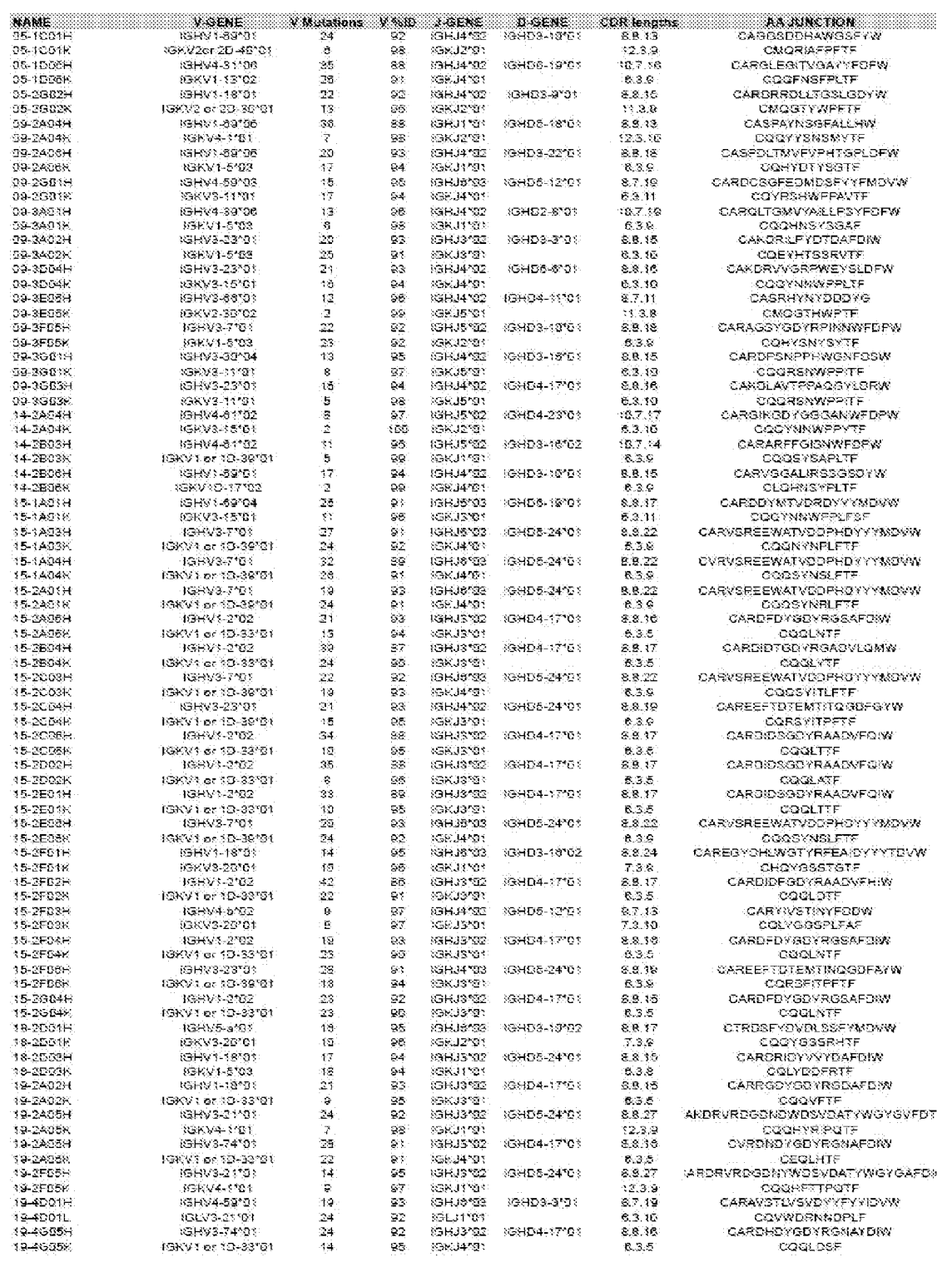

Table 1 (FIG. 12) provides detailed information, including sequence information, about each of the antibodies that were confirmed to bind influenza. Each antibody is identified in Col. A by antibody name and an indication of whether the heavy or light chain is being described. Heavy chains are indicated by H and light chains are indicated by L at the end of the identifier in Col. A. For example, line 1 of Table 1 (FIG. 12) discloses 005-2G02H, which is a heavy chain for one of the antibodies, and line 2 of Table 1 (FIG. 12) discloses 005-2G02L, which is the light chain for the same antibody. Accordingly, each pair of rows (2/3, 4/5, 6/7, 8/9, 10/11, 12/13, 14/15, 16/17, 18/19, 20/21, 22/23, 24/25, 26/27, 28/29, 30/31, 32/33, 34/35, 36/37, 38/39, 40/41, 42/43, 44/45, 46/47, 48/49, 50/51, 52/53, 54/55, 56/57, 58/59, 60/61, 62/63, 64/65, 66/67, 68/69, 70/71, 72/73, 74/75, 76/77, 78/79, 80/81, 82/83, 84/85, 86/87, 88/89, 90/91, 92/93, 94/95, 96/97, 98/99, 100/101, 102/103, 104/105, 106/107, 108/109, 110/111, 112/113, 114/115, 116/117, 118/119, 120/121, 122/123, 124/125, 126/127, 128/129, 130/131, 132/133, 134/135, 136/137, 138/139, and 140/141) represent paired heavy and light chains from a cloned human antibody. Col. G provides the V region amino acid sequence, column O provides the full translated V region amino acid sequence. Col. H provides the FR1 amino acid sequence. Col. I provides the CDR1 amino acid sequence. Col. J provides the FR2 amino acid sequence. Col. K provides the CDR2 amino acid sequence. Col. L provides the FR3 amino acid sequence. Col. M provides the CDR3 amino acid sequence. Col. N provides the nucleotide sequence. Column P provides the FR4 amino acid sequence. FIG. 14 provides the V gene, J gene D gene allele, and provides the V mutations, CDR lengths and AA junction sequence ("AA junction" sequences are disclosed in FIGS. 14A and 14B as SEQ ID NOS 1401-1540, respectively, in order of appearance).

Example 8

Materials and Methods

Patients and Vaccines:

All studies were approved by an institutional review board). Twenty-four healthy adult volunteers were given the monovalent pandemic H1N1 2009 vaccine. Subject 2 was given the seasonal 2009/10 TIV only 4 days before receiving pandemic H1N1 2009 vaccine and was excluded from all cross-reactivity assays. Memory B cell and mutational analysis data were derived from clinical studies of 2008/09 and 2009/10 season TIV vaccinees. Peripheral blood mononuclear cells (PBMCs) were isolated using Vacutainer tubes (BD for immediate use or cryopreserved. Plasma samples were saved at −80° C. for subsequent analysis. All vaccines were obtained from Sanofi Pasteur Inc.

Viruses and Antigens:

The pandemic H1N1 2009 influenza virus (A/California/04/09) was utilized. Other influenza virus stocks used for the assays were obtained from the Centers for Disease Control (CDC), grown in eggs and purified as described (Wrammert et al., 2008, supra). Recombinant HA proteins were provided by the CDC and by the Biodefense and Emerging Infections research repository.

ELISPOT and Memory B Cell Assay:

Direct ELISPOT to enumerate the number of either total IgG-secreting, pandemic H1N1 influenza virus-specific, vaccine-specific and recombinant HA-specific plasmablasts present in the PBMC samples was performed as previously described (Crotty et al., 2003, *J Immunol* 171(10):4969-4973).

Flow Cytometry Analysis and Cell Sorting.

Analytical and cell sorting flow cytometry analysis was performed as described (Wrammert et al., 2008, supra).

Generation of mAbs and Variable Gene Repertoire Analysis.

As previously detailed (Wrammert et al., 2008, supra; Smith et al., 2009, *Nat Protoc* 4(3):372-384; Wardemann et al., 2003, *Science* 301(5638):1374-1377), VH and Vκ genes were PCR-amplified from the transcripts of single ASCs and then sequenced. These variable genes were then cloned into IgG1 or Igκ expression vectors and co-transfected into the 293A cell line for expression. Variable genes were analyzed for identity and mutations using in-house analysis software and the IMGT search engine (Ehrenmann et al., 2010, *Nucleic Acids Res* 38(Database issue):D301-307; Lefranc et al., 2009, *Nucleic Acids Res* 37(Database issue):D1006-1012). Background mutation rate by this method is ~1 base-exchange per 1,000 bases sequenced (based on sequences of constant region gene segments). Comparisons were made to previously published data (Wrammert et al., 2008, supra; Zheng et al., 2005, *J Clin Invest* 113(8):1188-1201; Zeng et al., 2005b, *J Exp Med* 201(9):1467-1478). Antibody sequences were deposited on GENBANK®.

ELISA, HAI and Neutralization Assays.

Whole virus, recombinant HA, vaccine-specific ELISA, HAI and neutralization assays were performed as previously described (Wrammert et al., 2008, supra). For competition ELISA an additional pre-incubation with unlabeled competitor antibodies to the HA-stalk epitope at a 10-fold molar excess was then performed prior to application of the mAbs to the plate. Competitors consisted of one of two known stem-binding mAbs (70-1F02 or 70-5B03) or a negative control antibody specific for the HA globular head (EM-4C04). Competition level was calculated as the percentage inhibition of the half-maximal binding concentration of test antibody relative to the absorbance without competitor.

In view of the many possible embodiments to which the principles of the disclosed invention may be applied, it should be recognized that the illustrated embodiments are only preferred examples of the invention and should not be taken as limiting the scope of the invention. Rather, the scope of the invention is defined by the following claims. We therefore claim as our invention all that comes within the scope and spirit of these claims.

SEQUENCE LISTING (1541 sequences)

SEQ ID NO: 1 - protein, 98 aa, Homo sapiens
QVQLVQSGPEVKKPGASIKVSCRASGYTFSNYGITWVRQAPGQGLEWMGWISAYNGHTNSAQKFQGRVTMTTDTSTSTAYMEVRSLRSDDTAVYYCAR

SEQ ID NO: 2 - protein, 25 aa, Homo sapiens
QVQLVQSGPEVKKPGASIKVSCRAS

SEQ ID NO: 3 - protein, 8 aa, Homo sapiens
GYTFSNYG

SEQ ID NO: 4 - protein, 17 aa, Homo sapiens
ITWVRQAPGQGLEWMGW

SEQ ID NO: 5 - protein, 8 aa, Homo sapiens
ISAYNGHT

SEQ ID NO: 6 - protein, 38 aa, Homo sapiens
NSAQKFQGRVTMTTDTSTSTAYMEVRSLRSDDTAVYYC

SEQ ID NO: 7 - protein, 15 aa, Homo sapiens
ARDRRDLLTGSLGDY

SEQ ID NO: 8 - DNA, 367 bp, Homo sapiens
caggtgcagctggtgcagtctggacctgaggtgaagaagcctggggcctcaattaaggtctcctgcagggcttcaggatacaccttttccaattatggaatcacctgggtgcgacaggcccctggacaagggcttgagtggatgggctggatcagcgcttacaatggtcacacaaattctgcacagaagttccaggggagagtcaccatgaccacagacacatccacgagcacggcctacatggaggtgaggagcctcagatctgacgacacggccgtatattactgtgcgagagacagaagggatcttttgactggttcgttgggggactactggggccagggaaccctggtcaccgtctcctcag

SEQ ID NO: 9 - protein, 122 aa, Homo sapiens
QVQLVQSGPEVKKPGASIKVSCRASGYTFSNYGITWVRQAPGQGLEWMGWISAYNGHTNSAQKFQGRVTMTTDTSTSTAYMEVRSLRSDDTAVYYCARDRRDLLTGSLGDYWGQGTLVTVSS

SEQ ID NO: 10 - protein, 11 aa, Homo sapiens
WGQGTLVTVSS

SEQ ID NO: 11 - protein, 99 aa, Homo sapiens
DVVMTQSPLSLPVTLGQPASISCRSSRGLLYIDGNTYLNWFQQRPGQSPRRLIHNVSNRDSGVPDRFSGSGSRTDFTLKISRVEAEDVGVYYCMQGTYW

SEQ ID NO: 12 - protein, 26 aa, Homo sapiens
DVVMTQSPLSLPVTLGQPASISCRSS

SEQ ID NO: 13 - protein, 11 aa, Homo sapiens
RGLLYIDGNTY

SEQ ID NO: 14 - protein, 17 aa, Homo sapiens
LNWFQQRPGQSPRRLIH

SEQ ID NO: 15 - skipped

SEQ ID NO: 16 - protein, 36 aa, Homo sapiens
NRDSGVPDRFSGSGSRTDFTLKISRVEAEDVGVYYC

SEQ ID NO: 17 - protein, 9 aa, Homo sapiens
MQGTYWPFT

SEQ ID NO: 18 - DNA, 337 bp, Homo sapiens
gatgttgtgatgactcagtctccactctccctgcccgtcacccttggacagccggcctccatctcctgcaggtctagtcgaggcctcctttatattgatggaaacacctacttgaattggtttcaacagaggccaggccaatctccaaggcgcctaattcataacgtttctaacagggactctggggtcccagacagattcagcggcagtgggtcacgcactgatttcacactgaaaatcagcagggtggaggctgaagatgttggggtttattactgcatgcaaggtacatactggccgttcacttttggccaggggaccaaggtggaaatcaaac

SEQ ID NO: 19 - protein, 112 aa, Homo sapiens
DVVMTQSPLSLPVTLGQPASISCRSSRGLLYIDGNTYLNWFQQRPGQSPRRLIHNVSNRDSGVPDRFSGSGSRTDFTLKISRVEAEDVGVYYCMQGTYWPFTFGQGTKVEIK

SEQ ID NO: 20 - protein, 10 aa, Homo sapiens
FGQGTKVEIK

SEQ ID NO: 21 - protein, 97 aa, Homo sapiens
QVQLVQSGAEVKRPGSSVTVSCKASGGSFTSFVISWVRQAPGQGLEWMGGVIPIFATPKYAQKFQGRLTITADKSTNTAYMELTSLRSEDTAMYYCA

SEQ ID NO: 22 - protein, 25 aa, Homo sapiens
QVQLVQSGAEVKRPGSSVTVSCKAS

SEQ ID NO: 23 - protein, 8 aa, Homo sapiens
GGSFTSFV

SEQ ID NO: 24 - protein, 17 aa, Homo sapiens
ISWVRQAPGQGLEWMGG

SEQ ID NO: 25 - protein, 8 aa, Homo sapiens
VIPIFATP

SEQ ID NO: 26 - protein, 38 aa, Homo sapiens
KYAQKFQGRLTITADKSTNTAYMELTSLRSEDTAMYYC

SEQ ID NO: 27 - protein, 18 aa, Homo sapiens
ASPDLTMVFVPHTGPLDF

SEQ ID NO: 28 - DNA, 376 bp, Homo sapiens
caggtgcagctggtgcagtctggggctgaggtgaagaggccggggtcctcggtgacggtctcctgcaaggcttctggaggctccttcaccagctttgttatcagctgggtgcgacaggcccctggacaagggcttgagtggatgggaggggtcatccctatttttgctacaccaaagtacgcacagaagttccagggcagactcaccattaccgcggacaagtccacaaatacagcctacatggagctgaccagcctgagatctgaggacacggccatgtattactgtgcgagtccggacttgactatggtattcgtgccgcacaccggaccacttgacttctggggccagggaaccctggtcaccgtctcctcag

SEQ ID NO: 29 - protein, 125 aa, Homo sapiens
QVQLVQSGAEVKRPGSSVTVSCKASGGSFTSFVISWVRQAPGQGLEWMGGVIPIFATPKYAQKFQGRLTITADKSTNTAYMELTSLRSEDTAMYYCASPDLTMVFVPHTGPLDFWGQGTLVTVSS

SEQ ID NO: 30 - protein, 11 aa, Homo sapiens
WGQGTLVTVSS

SEQ ID NO: 31 - protein, 94 aa, Homo sapiens
DIQMTQSPSTLSASVGDRVTITCRASQSIDNWLAWYQQKPGKAPNLLIYKASSLRSGVPSRFSGSGSGTEFTLTISSLQPDDFATYYCQHYDTY

SEQ ID NO: 32 - protein, 26 aa, Homo sapiens
DIQMTQSPSTLSASVGDRVTITCRAS

SEQ ID NO: 33 - protein, 6 aa, Homo sapiens
QSIDNW

SEQ ID NO: 34 - protein, 17 aa, Homo sapiens
LAWYQQKPGKAPNLLIY

SEQ ID NO: 35 - skipped

SEQ ID NO: 36 - protein, 36 aa, Homo sapiens
SLRSGVPSRFSGSGSGTEFTLTISSLQPDDFATYYC

SEQ ID NO: 37 - protein, 9 aa, Homo sapiens
QHYDTYSGT

SEQ ID NO: 38 - DNA, 322 bp, Homo sapiens
gacatccagatgacccagtctccgtccaccctgtctgcatctgtcggagacagagtcaccatcacttgccgggccagtcagagcattgataactggttggcctggtatcagcagaaaccagggaaagcccccaacctcctgatctataaggcgtctagtttacgaagtggggtcccatcaaggttcagcggcagtggatctggcacagagttcactctcaccatcagcagcctgcagccggatgattttgctacttattactgccaacattatgatacttattcggggacgttcggccaagggaccaaggtggaaatcaaac

SEQ ID NO: 39 - protein, 107 aa, Homo sapiens
DIQMTQSPSTLSASVGDRVTITCRASQSIDNWLAWYQQKPGKAPNLLIYKASSLRSGVPSRFSGSGSGTEFTLTISSLQPDDFATYYCQHYDTYSGTFGQGTKVEIK

SEQ ID NO: 40 - protein, 10 aa, Homo sapiens
FGQGTKVEIK

SEQ ID NO: 41 - protein, 99 aa, Homo sapiens
RLQLQESGPGLVKPSETLSLTCTVSGGSITSNTYYWGWIRQPPGKGLESIGSISFSGRTYYSPSLKSRVTMSVDTSKNQFSLKLSSVTAADTAFYYCAR

SEQ ID NO: 42 - protein, 25 aa, Homo sapiens
RLQLQESGPGLVKPSETLSLTCTVS

SEQ ID NO: 43 - protein, 10 aa, Homo sapiens
GGSITSNTYY

SEQ ID NO: 44 - protein, 17 aa, Homo sapiens
WGWIRQPPGKGLESIGS

SEQ ID NO: 45 - protein, 7 aa, Homo sapiens
ISFSGRT

SEQ ID NO: 46 - protein, 38 aa, Homo sapiens
YYSPSLKSRVTMSVDTSKNQFSLKLSSVTAADTAFYYC

SEQ ID NO: 47 - protein, 19 aa, Homo sapiens
ARQLTGMVYAILLPSYFDF

SEQ ID NO: 48 - DNA, 382 bp, Homo sapiens
cggctgcagctgcaggagtcgggcccaggactggtgaagccttcggagaccctgtccctcacctgcactgtctctggtggctccatcaccagtaacacttactactggggctggatccgccagcccccagggaaggggctggagtcgattgggagtatctcttttagtgggagaacctactacagcccgtccctcaagagtcgagtcaccatgtcagtagacacgtccaagaaccagttctccctgaagctgagctctgtgaccgccgcggacacggccttttattactgtgcgagacagttaacagggatggtttatgctattctcttaccgtcctactttgacttctggggccagggcaccctggtcaccgtctcctcag

SEQ ID NO: 49 - protein, 127 aa, Homo sapiens
RLQLQESGPGLVKPSETLSLTCTVSGGSITSNTYYWGWIRQPPGKGLESIGSISFSGRTYYSPSLKSRVTMSVDTSKNQFSLKLSSVTAADTAFYYCARQLTGMVYAILLPSYFDFWGQGTLVTVSS

SEQ ID NO: 50 - protein, 11 aa, Homo sapiens
WGQGTLVTVSS

SEQ ID NO: 51 - protein, 94 aa, Homo sapiens
DIQMTQSPSTLSASVGDRVTITCRASQSIGSWLAWYQQKPGKAPKLLIYKASTLESGVPSRFSGSGSGTEFTLTISSLQPDDLATYYCQQHNSY

SEQ ID NO: 52 - protein, 26 aa, Homo sapiens
DIQMTQSPSTLSASVGDRVTITCRAS

SEQ ID NO: 53 - protein, 6 aa, Homo sapiens
QSIGSW

SEQ ID NO: 54 - protein, 17 aa, Homo sapiens
LAWYQQKPGKAPKLLIY

SEQ ID NO: 55 - skipped

SEQ ID NO: 56 - protein, 36 aa, Homo sapiens
TLESGVPSRFSGSGSGTEFTLTISSLQPDDLATYYC

SEQ ID NO: 57 - protein, 9 aa, Homo sapiens
QQHNSYSGA

SEQ ID NO: 58 - DNA, 376 bp, Homo sapiens; identical to SEQ ID NO: 28

SEQ ID NO: 59 - protein, 125 aa, Homo sapiens; identical to SEQ ID NO: 29

SEQ ID NO: 60 - protein, 10 aa, Homo sapiens
FGQGTKVEIK

SEQ ID NO: 61 - protein, 97 aa, Homo sapiens
QVQLVESGAEVKKPGSSVRVSCKLSGGTFSTHGINWVRQAPGQGLEWMGGIIPIFGSAKYAQKFQDRVTITADESTRTAYMEVTRLRSEDTATIYCA

SEQ ID NO: 62 - protein, 25 aa, Homo sapiens
QVQLVESGAEVKKPGSSVRVSCKLS

SEQ ID NO: 63 - protein, 8 aa, Homo sapiens
GGTFSTHG

SEQ ID NO: 64 - protein, 17 aa, Homo sapiens
INWVRQAPGQGLEWMGG

SEQ ID NO: 65 - protein, 8 aa, Homo sapiens
IIPIFGSA

SEQ ID NO: 66 - protein, 38 aa, Homo sapiens
KYAQKFQDRVTITADESTRTAYMEVTRLRSEDTATIYC

SEQ ID NO: 67 - protein, 13 aa, Homo sapiens
AGGSDDHAWGSFY

SEQ ID NO: 68 - DNA, 480 bp, Homo sapiens
caggtgcagctggtggagtctggggctgaggtgaagaagcctgggtcctcggtgagggtctcctgcaaactttctggaggcaccttcagcacccatggtatcaactgggtgcgacaggcccccggacaagggcttgagtggatgggagggatcatccctatttttggttcagcaaagtatgcacagaagttccaggacagagtcacgattaccgcggacgaatccacgaggacagcctacatggaggtgacccgcctgagatctgaggacacggccacgatttattgtgcgggggggagcgatgatcacgcttgggggagtttttactggggccagggaaccccggtcaccgtttcctcagcctccaccaagggcccatcggtcttccccctggcaccctcctccaggagcacctctgggggcacagcggccctgggctgcctggtcaaggactacttccccgaaccggtgacggtgtcg

SEQ ID NO: 69 - protein, 120 aa, Homo sapiens
QVQLVESGAEVKKPGSSVRVSCKLSGGTFSTHGINWVRQAPGQGLEWMGGIIPIFGSAKYAQKFQDRVTITADESTRTAYMEVTRLRSEDTATIYCAGGSDDHAWGSFYWGQGTPVTVSS

SEQ ID NO: 70 - protein, 11 aa, Homo sapiens
WGQGTPVTVSS

SEQ ID NO: 71 - protein, 100 aa, Homo sapiens
  MOD_RES (30)..(30): Any amino acid
DIVMTQTPLSLPVTPGEPASISCRSSQSLXDSDDGNTSLDWYLQKAGQSPQLLIYTLSYRASGVPDRFSGSGSGTDFTLKISRVEAEDVGVYYCMQRIAF

SEQ ID NO: 72 - protein, 26 aa, Homo sapiens
DIVMTQTPLSLPVTPGEPASISCRSS

SEQ ID NO: 73 - protein, 12 aa, Homo sapiens
  MOD_RES (4)..(4): Any amino acid
QSLXDSDDGNTS

SEQ ID NO: 74 - protein, 17 aa, Homo sapiens
LDWYLQKAGQSPQLLIY

SEQ ID NO: 75 - skipped

SEQ ID NO: 76 - protein, 36 aa, Homo sapiens
YRASGVPDRFSGSGSGTDFTLKISRVEAEDVGVYYC

SEQ ID NO: 77 - protein, 9 aa, Homo sapiens
MQRIAFPFT

SEQ ID NO: 78 - DNA, 483 bp, Homo sapiens
  modified_base (89)..(89): a, c, t, g, unknown or other
  misc_feature (89)..(89): a, c, t, g, unknown or other
gatattgtgatgacccagactccactctccctgcccgtcacccctggagagccggcctccatctcctgcaggtctagtcagagcctctnggatagtgatgatggaaacacctctttggactggtacctgcagaaggcagggcagtctccacagctcctgatctatacgctttcctatcgggcctctggagtcccagacaggttcagtggcagtgggtcaggcactgatttcacactgaaaatcagcagggtggaggctgaggatgttggagtttattattgcatgcaacgtatagcatttccgttcacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaa

SEQ ID NO: 79 - protein, 113 aa, Homo sapiens
  MOD_RES (30)..(30): Any amino acid
DIVMTQTPLSLPVTPGEPASISCRSSQSLXDSDDGNTSLDWYLQKAGQSPQLLIYTLSYRASGVPDRFSGSGSGTDFTLKISRVEAEDVGVYYCMQRIAFPFTFGQGTKLEIK

SEQ ID NO: 80 - protein, 10 aa, Homo sapiens
FGQGTKLEIK

SEQ ID NO: 81 - protein, 98 aa, Homo sapiens
QVQLVQSGAEVKKPGESLKISCRAYEYTFTAFCVGWVRQMPGTGLEWMGIICPGDSDLKYSPSFQGQVTISADKSITTAYLQWSSLKASDTATYYCAR

SEQ ID NO: 82 - protein, 25 aa, Homo sapiens
QVQLVQSGAEVKKPGESLKISCRAY

SEQ ID NO: 83 - protein, 8 aa, Homo sapiens
EYTFTAFC

SEQ ID NO: 84 - protein, 17 aa, Homo sapiens
VGWVRQMPGTGLEWMGI

SEQ ID NO: 85 - protein, 8 aa, Homo sapiens
ICPGDSDL

SEQ ID NO: 86 - protein, 38 aa, Homo sapiens
KYSPSFQGQVTISADKSITTAYLQWSSLKASDTATYYC

SEQ ID NO: 87 - protein, 15 aa, Homo sapiens
RHVASHWGDYYGMDL

SEQ ID NO: 88 - DNA, 480 bp, Homo sapiens
caggtgcagctggtgcagtctggggcagaagtgaaaaagcccggggagtctctgaagatctcctgtagggcttatgaatacaccttcaccgccttctgcgtcggctgggtgcgccagatgcccggcacaggcctggagtggatggggatcatctgtcctggtgactctgatctcaaatacagtccgtccttccaaggccaggtcaccatctcagccgacaagtccatcaccaccgcctacctgcagtggagcagcctgaaggcctcggacaccgccacatattactgtgcgagacatgtggcaagtcactggggcgactattacggtatggacctctggggccaaggacctcggtcagcgtctcgtcagcacccaccaaggctccggatgtgttccccatcatatcagggtgcagacacacctctgggggcacagcggccctgggctgcctggtcaaggactacttccccgaaccggtga

SEQ ID NO: 89 - protein, 159 aa, Homo sapiens
QVQLVQSGAEVKKPGESLKISCRAYEYTFTAFCVGWVRQMPGTGLEWMGIICPGDSDLKYSPSFQGQVTISADKSITTAYLQWSSLKASDTATYYCARHVASHWGDYYGMDLWGQGPRSASRQHPPRLRMCSPSYQGADTPLGAQRPWAAWSRTTSPNR

SEQ ID NO: 90 - protein, 11 aa, Homo sapiens
WGQGTSVSVSS

SEQ ID NO: 91 - protein, 94 aa, Homo sapiens
EIVLTQSPGTLSVSPGERVTLSCRASQSVTRNLAWYQQRPGQAPRLLIYSASTRAIGIPVRFSGRGSGTDFTLSISSLQSEDSAVYYCQQYNDW

SEQ ID NO: 92 - protein, 26 aa, Homo sapiens
EIVLTQSPGTLSVSPGERVTLSCRAS

SEQ ID NO: 93 - protein, 6 aa, Homo sapiens
QSVTRN

SEQ ID NO: 94 - protein, 17 aa, Homo sapiens
LAWYQQRPGQAPRLLIY

SEQ ID NO: 95 - skipped

SEQ ID NO: 96 - protein, 36 aa, Homo sapiens
TRAIGIPVRFSGRGSGTDFTLSISSLQSEDSAVYYC

SEQ ID NO: 97 - protein, 10 aa, Homo sapiens
QQYNDWLGGT

SEQ ID NO: 98 - DNA, 483 bp, Homo sapiens
gaaattgtgttgacgcagtctccaggcaccctgtctgtgtctccaggagaaagagtcacactctcctgcagggccagccagagtgttaccagaaacttagcctggtaccaacagagacctggccaggctcccaggctcctcatctatagtgcatccaccagggccattggtatcccagtcaggttcagtggccgggggtctgggacagacttcactctcagcatcagcagcctgcagtctgaagattctgcagtttattattgtcagcagtataatgactggctcggggggaccttcggccaggggaccaaagtggaaattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccag

SEQ ID NO: 99 - protein, 108 aa, Homo sapiens
EIVLTQSPGTLSVSPGERVTLSCRASQSVTRNLAWYQQRPGQAPRLLIYSASTRAIGIPVRFSGRGSGTDFTLSISSLQSEDSAVYYCQQYNDWLGGTFGQGTKVEIK

SEQ ID NO: 100 - protein, 10 aa, Homo sapiens
FGQGTKVEIK

SEQ ID NO: 101 - protein, 99 aa, Homo sapiens
QVQLQQSGPGLVKPSQTLSLRCTISGDSVTSATYYWTWIRQRPGKGLEWIGNIFKGGNTNYNPSLKSRVAISVDTSTNQFSLTLRSVTAADAAVYFCAR

SEQ ID NO: 102 - protein, 25 aa, Homo sapiens
QVQLQQSGPGLVKPSQTLSLRCTIS

SEQ ID NO: 103 - protein, 10 aa, Homo sapiens
GDSVTSATYY

SEQ ID NO: 104 - protein, 17 aa, Homo sapiens
WTWIRQRPGKGLEWIGN

SEQ ID NO: 105 - protein, 7 aa, Homo sapiens
IFKGGNT

SEQ ID NO: 106 - protein, 38 aa, Homo sapiens
NYNPSLKSRVAISVDTSTNQFSLTLRSVTAADAAVYFC

SEQ ID NO: 107 - protein, 16 aa, Homo sapiens
ARGLEGITVGAYYFDF

SEQ ID NO: 108 - DNA, 481 bp, Homo sapiens
caggtacagctgcagcagtcaggtccaggactggtgaagccttcacagaccctgtccctcagatgcactatttcgggtgactccgtcaccagtgcgacttactactggacctggatccgccagcgcccagggaagggcctggagtggattgggaacatctttaaaggtgggaacaccaactacaacccgtccctgaagagtcgagttgccatatcagtggacacgtctacgaaccagttctccctgactctgaggtctgtgacggccgcggacgcggccgtgtatttttgtgcgagaggccttgagggcataacagtgggcgcctactattttgacttctggggccagggagcccttgtcaccgtctcctcagcctccaccaagggcccatcggtcttccccctggcaccctcctccaagagcacctctgggggcacagcggccctgggctgcctggtcaaggactacttccccgaaccgg

SEQ ID NO: 109 - protein, 124 aa, Homo sapiens
QVQLQQSGPGLVKPSQTLSLRCTISGDSVTSATYYWTWIRQRPGKGLEWIGNIFKGGNTNYNPSLKSRVAISVDTSTNQFSLTLRSVTAADAAVYFCARGLEGITVGAYYFDFWGQGALVTVSS

SEQ ID NO: 110 - protein, 11 aa, Homo sapiens
WGQGALVTVSS

SEQ ID NO: 111 - protein, 94 aa, Homo sapiens
AIQLTQSPSSVSASVGDRVTITCRASQEINYALAWYLQKPGKPPKVLIYNASTMKNGVPSRFGGNGSGPDFTLTINNLQPEDFGTYYCQQFNSF

SEQ ID NO: 112 - protein, 26 aa, Homo sapiens
AIQLTQSPSSVSASVGDRVTITCRAS

SEQ ID NO: 113 - protein, 6 aa, Homo sapiens
QEINYA

SEQ ID NO: 114 - protein, 17 aa, Homo sapiens
LAWYLQKPGKPPKVLIY

SEQ ID NO: 115 - skipped

SEQ ID NO: 116 - protein, 36 aa, Homo sapiens
TMKNGVPSRFGGNGSGPDFTLTINNLQPEDFGTYYC

SEQ ID NO: 117 - protein, 9 aa, Homo sapiens
QQFNSFPLT

SEQ ID NO: 118 - DNA, 566 bp, Homo sapiens
gccatccagttgacccagtctccatcctccgtgtctgcatctgtaggagacagagtcaccatcacttgccgggcaagtcaggaaattaactatgctttagcctggtatctgcaaaaaccaggaaaacctccaaaggtcctgatctataatgcctccaccatgaaaaatggggtcccatcaaggttcggcggcaatggatctgggccagatttcactctcaccatcaacaacctgcagcctgaagactttggaacttattactgtcaacagtttaatagtttcccgctcactttcggcggggggaccagggtggacattagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaaca

SEQ ID NO: 119 - protein, 107 aa, Homo sapiens
AIQLTQSPSSVSASVGDRVTITCRASQEINYALAWYLQKPGKPPKVLIYNASTMKNGVPSRFGGNGSGPDFTLTINNLQPEDFGTYYCQQFNSFPLTFGGGTRVDIR

SEQ ID NO: 120 - protein, 10 aa, Homo sapiens
FGGGTRVDIR

SEQ ID NO: 121 - protein, 99 aa, Homo sapiens
QVQLQESGPGLVKPSQTLSLTCTISGDSVSSATYYWTWIRQRPGKGLEWIGNIFNSGSTNYNPSLKSRVAISVDTSRNQFSLTLNSLTAADTAVYFCAR

SEQ ID NO: 122 - protein, 25 aa, Homo sapiens
QVQLQESGPGLVKPSQTLSLTCTIS

SEQ ID NO: 123 - protein, 10 aa, Homo sapiens
GDSVSSATYY

SEQ ID NO: 124 - protein, 17 aa, Homo sapiens
WTWIRQRPGKGLEWIGN

SEQ ID NO: 125 - protein, 7 aa, Homo sapiens
IFNSGST

SEQ ID NO: 126 - protein, 38 aa, Homo sapiens
NYNPSLKSRVAISVDTSRNQFSLTLNSLTAADTAVYFC

SEQ ID NO: 127 - protein, 16 aa, Homo sapiens
ARGLEGITVGVYYCDF

SEQ ID NO: 128 - DNA, 482 bp, Homo sapiens
caggtgcagctgcaggagtcgggcccaggactggtgaagccttcacagaccctgtccctcacctgcactatctcaggtgactccgtcagcagtgcgacttactactggacctggatccgccagcgcccagggaagggcctggagtggattgggaacatctttaacagtgggagtaccaactacaacccgtccctcaagagtcgagttgccatatcagtggacacgtctaggaaccagttctccctgactctgaattctctgactgccgcggacacggccgtgtatttttgtgcgagaggccttgagggcataacagtgggggtctactattgtgacttctggggccagggaaccctggtcaccgtctcctcagcctccaccaagggcccatcggtcttccccctggcaccctcctccaggagcacctctgggggcacagcggccctgggctgcctggtcaaggactacttccccgaaccggt

SEQ ID NO: 129 - protein, 124 aa, Homo sapiens
QVQLQESGPGLVKPSQTLSLTCTISGDSVSSATYYWTWIRQRPGKGLEWIGNIFNSGSTNYNPSLKSRVAISVDTSRNQFSLTLNSLTAADTAVYFCARGLEGITVGVYYCDFWGQGTLVTVSS

SEQ ID NO: 130 - protein, 11 aa, Homo sapiens
WGQGTLVTVSS

SEQ ID NO: 131 - protein, 94 aa, Homo sapiens
AIQMTQSPSSVSASVGDRVTITCRASQEINYALAWYLQKPGKPPKVLIYNASTLKNGVPSRFGGDGSGPDFTLTISNLQPEDFGTYYCQQFNSY

SEQ ID NO: 132 - protein, 26 aa, Homo sapiens
AIQMTQSPSSVSASVGDRVTITCRAS

SEQ ID NO: 133 - protein, 6 aa, Homo sapiens
QEINYA

SEQ ID NO: 134 - protein, 17 aa, Homo sapiens
LAWYLQKPGKPPKVLIY

SEQ ID NO: 135 - skipped

SEQ ID NO: 136 - protein, 36 aa, Homo sapiens
TLKNGVPSRFGGDGSGPDFTLTISNLQPEDFGTYYC

SEQ ID NO: 137 - protein, 9 aa, Homo sapiens
QQFNSYPLT

SEQ ID NO: 138 - DNA, 484 bp, Homo sapiens
gccatccagatgacccagtctccatcctccgtgtctgcatctgtaggagacagagtcaccatcacttgccgggcaagtcaggaaattaactatgctttagcctggtatctgcaaaaaccaggaaaacctccaaaggtcctgatctataatgcctccaccttgaaaaatggggtcccatcaaggttcggcggcgatggatctgggccagatttcactctcaccatcagcaacctgcagcctgaagactttggaacttattactgtcaacagtttaatagttacccgctcactttcggcggggggaccaaggtggacattagacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggaga

SEQ ID NO: 139 - protein, 107 aa, Homo sapiens
AIQMTQSPSSVSASVGDRVTITCRASQEINYALAWYLQKPGKPPKVLIYNASTLKNGVPSRFGGDGSGPDFTLTISNLQPEDFGTYYCQQFNSYPLTFGGGTKVDIR

SEQ ID NO: 140 - protein, 10 aa, Homo sapiens
FGGGTKVDIR

SEQ ID NO: 141 - protein, 97 aa, Homo sapiens
  MOD_RES (76)..(81): Any amino acid
QVQLVQSGAEVKKPGSSVKVSCKASGGTFNTYIINWVRQAPGQGLEWMGRINPSFGSVNYAQRFQGRVTITADNSXXXXXXELNSLRSEDTAVYYCA

SEQ ID NO: 142 - protein, 25 aa, Homo sapiens [sequence omitted]

SEQ ID NO: 143 - protein, 8 aa, Homo sapiens
GGTFNTYI

SEQ ID NO: 144 - protein, 17 aa, Homo sapiens
INWVRQAPGQGLEWMGR

SEQ ID NO: 145 - protein, 8 aa, Homo sapiens
INPSFGSV

SEQ ID NO: 146 - protein, 38 aa, Homo sapiens
  MOD_RES (18)..(23): Any amino acid
NYAQRFQGRVTITADNSXXXXXXELNSLRSEDTAVYYC

SEQ ID NO: 147 - protein, 13 aa, Homo sapiens
ASPAYNSGFALLH

SEQ ID NO: 148 - DNA, 483 bp, Homo sapiens
  modified_base (227)..(241): a, c, t, g, unknown or other
  misc_feature (227)..(241): a, c, t, g, unknown or other
caggtgcagctggtgcagtctggggctgaagtgaagaagcctgggtcgtcggtgaaggtctcctgtaaggcttctggaggcaccttcaacacctatattataaattgggtgcgacaggcccctggacaagggcttgagtggatgggaaggatcaaccctagctttggttcagtaaactacgcacagaggtttcagggcagagtcacgatcaccgcggacaactccannnnnnnnnnnnnnntggagttgaacagcctgagatctgaggacacggccgtgtattactgtgcgagccccgcatacaattctggtttcgcgttacttcactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtgg

SEQ ID NO: 149 - protein, 120 aa, Homo sapiens
  MOD_RES (76)..(81): Any amino acid
QVQLVQSGAEVKKPGSSVKVSCKASGGTFNTYIINWVRQAPGQGLEWMGRINPSFGSVNYAQRFQGRVTITADNSXXXXXXELNSLRSEDTAVYYCASPAYNSGFALLHWGQGTLVTVSS

SEQ ID NO: 150 - protein, 11 aa, Homo sapiens
WGQGTLVTVSS

SEQ ID NO: 151 - protein, 99 aa, Homo sapiens
DIVMTQSPDSLGVSLGERATINCKSSQSVLYTSNNKNYLAWFQQKPGQPPKLLIYWASTRASGVPDRFSGSGSGTDFTLTISSLQAEDVAVYYCQQYYS

SEQ ID NO: 152 - protein, 26 aa, Homo sapiens
DIVMTQSPDSLGVSLGERATINCKSS

SEQ ID NO: 153 - protein, 12 aa, Homo sapiens
QSVLYTSNNKNY

SEQ ID NO: 154 - protein, 17 aa, Homo sapiens
LAWFQQKPGQPPKLLIY

SEQ ID NO: 155 - skipped

SEQ ID NO: 156 - protein, 36 aa, Homo sapiens
TRASGVPDRFSGSGSGTDFTLTISSLQAEDVAVYYC

SEQ ID NO: 157 - protein, 10 aa, Homo sapiens
QQYYSNSMYT

SEQ ID NO: 158 - DNA, 482 bp, Homo sapiens
gacatcgtgatgacccagtctccagactccctgggtgtgtctctgggcgagagggccaccatcaactgcaagtccagccagagtgttttatacacctccaacaataagaactacttagcttggttccagcagaaaccaggacagcctcctaagctgctcatttactgggcatctacccgggcatccggagtccctgaccgattcagtggcagcgggtctgggacagacttcactctcaccatcagcagcctgcaggctgaagatgtggcagtttattactgtcaacaatattatagtaattccatgtacacttttggccaggggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccct

SEQ ID NO: 159 - protein, 114 aa, Homo sapiens
DIVMTQSPDSLGVSLGERATINCKSSQSVLYTSNNKNYLAWFQQKPGQPPKLLIYWASTRASGVPDRFSGSGSGTDFTLTISSLQAEDVAVYYCQQYYSNSMYTFGQGTKVEIK

SEQ ID NO: 160 - protein, 10 aa, Homo sapiens
FGQGTKVEIK

SEQ ID NO: 161 - protein, 96 aa, Homo sapiens
QVQLQESGPGLVKPSETLSLTCSVSGGSISSYYWTWIRQPPGKGLEWIGNIYYSGSTYYSPSLKSRVTISIDTSKNQFSLKLNSVTTADTAVYYCA

SEQ ID NO: 162 - protein, 25 aa, Homo sapiens
QVQLQESGPGLVKPSETLSLTCSVS

SEQ ID NO: 163 - protein, 8 aa, Homo sapiens
GGSISSYY

SEQ ID NO: 164 - protein, 17 aa, Homo sapiens
WTWIRQPPGKGLEWIGN

SEQ ID NO: 165 - protein, 7 aa, Homo sapiens
IYYSGST

SEQ ID NO: 166 - protein, 38 aa, Homo sapiens
YYSPSLKSRVTISIDTSKNQFSLKLNSVTTADTAVYYC

SEQ ID NO: 167 - protein, 19 aa, Homo sapiens
ARDCSGFEDMDSFYYFMDV

SEQ ID NO: 168 - DNA, 480 bp, Homo sapiens
caggtgcagctgcaggagtcgggcccaggactggtgaagccttcggagaccctgtccctcacctgcagtgtctctggtggctccatcagtagttactactggacctggatccgacagcccccagggaaggggctggagtggattgggaacatctattacagtgggagcacgtactacagcccctccctcaagagtcgagtcaccatatcaatagacacgtccaagaaccaattctccctgaaactaaactctgtgaccactgcggacacggccgtttattactgtgcgagggactgtagtggcttcgaagacatggactccttctactacttcatggacgtctggggcaaaggggccacggtcaccgtctcctcagcgtcgaccaagggcccatcggtcttccccctggcaccctcctccaagagcacctctgggggcacagcggccctgggctgcctggtcaaggactacttccccgaa

SEQ ID NO: 169 - protein, 125 aa, Homo sapiens
QVQLQESGPGLVKPSETLSLTCSVSGGSISSYYWTWIRQPPGKGLEWIGNIYYSGSTYYSPSLKSRVTISIDTSKNQFSLKLNSVTTADTAVYYCARDCSGFEDMDSFYYFMDVWGKGATVTVSS

SEQ ID NO: 170 - protein, 11 aa, Homo sapiens
WGKGATVTVSS

SEQ ID NO: 171 - protein, 95 aa, Homo sapiens
EIVLTQSPATLSLSPGERATLSCRASQRLTSSLSWYQQKPGQAPRLLIYAASNRATGVPARFSGSGSGTDFTLTISSLEPEDFAVYYCQYRSHWP

SEQ ID NO: 172 - protein, 26 aa, Homo sapiens [sequence omitted]

SEQ ID NO: 173 - protein, 6 aa, Homo sapiens
QRLTSS

SEQ ID NO: 174 - protein, 17 aa, Homo sapiens
LSWYQQKPGQAPRLLIY

SEQ ID NO: 175 - skipped

SEQ ID NO: 176 - protein, 36 aa, Homo sapiens
NRATGVPARFSGSGSGTDFTLTISSLEPEDFAVYYC

SEQ ID NO: 177 - protein, 11 aa, Homo sapiens
QYRSHWPPAVT

SEQ ID NO: 178 - DNA, 482 bp, Homo sapiens
gaaattgtgttgacacagtctccggccaccctgtctttgtctccaggggaaagagccaccctctcctgcagggccagtcagcgtcttaccagctccttatcctggtaccaacaaaagcctggccaggctcccaggctcctcatttatgctgcatccaacagggccactggcgtcccagccaggttcagtggcagtgggtctgggacagacttcactctcaccatcagcagcctggagcctgaagattttgcggtttattactgtcagtaccgaagccactggcctccggcggtcactttcggcggagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactc

SEQ ID NO: 179 - protein, 109 aa, Homo sapiens
EIVLTQSPATLSLSPGERATLSCRASQRLTSSLSWYQQKPGQAPRLLIYAASNRATGVPARFSGSGSGTDFTLTISSLEPEDFAVYYCQYRSHWPPAVTFGGGTKVEIK

SEQ ID NO: 180 - protein, 10 aa, Homo sapiens
FGGGTKVEIK

SEQ ID NO: 181 - protein, 99 aa, Homo sapiens; identical to SEQ ID NO: 41

SEQ ID NO: 182 - protein, 25 aa, Homo sapiens
RLQLQESGPGLVKPSETLSLTCTVS

SEQ ID NO: 183 - protein, 10 aa, Homo sapiens
GGSITSNTYY

SEQ ID NO: 184 - protein, 17 aa, Homo sapiens
WGWIRQPPGKGLESIGS

SEQ ID NO: 185 - protein, 7 aa, Homo sapiens
ISFSGRT

SEQ ID NO: 186 - protein, 38 aa, Homo sapiens; identical to SEQ ID NO: 46

SEQ ID NO: 187 - protein, 19 aa, Homo sapiens
ARQLTGMVYAILLPSYFDF

SEQ ID NO: 188 - DNA, 482 bp, Homo sapiens
cggctgcagctgcaggagtcgggcccaggactggtgaagccttcggagaccctgtccctcacctgcactgtctctggtggctccatcaccagtaacacttactactggggctggatccgccagcccccagggaaggggctggagtcgattgggagtatctcttttagtgggagaacctactacagcccgtccctcaagagtcgagtcaccatgtcagtagacacgtccaagaaccagttctccctgaagctgagctctgtgaccgccgcggacacggccttttattactgtgcgagacagttaacagggatggtttatgctattctcttaccgtcctactttgacttctggggccagggcaccctggtcaccgtctcctcagcgtcgaccaagggcccatcggtcttccccctggcaccctcctccaagagcacctctgggggcacagcggccctgggctgcctggtcaaggactacttccc

SEQ ID NO: 189 - protein, 127 aa, Homo sapiens; identical to SEQ ID NO: 49

SEQ ID NO: 190 - protein, 11 aa, Homo sapiens
WGQGTLVTVSS

SEQ ID NO: 191 - protein, 94 aa, Homo sapiens; identical to SEQ ID NO: 51

SEQ ID NO: 192 - protein, 26 aa, Homo sapiens
DIQMTQSPSTLSASVGDRVTITCRAS

SEQ ID NO: 193 - protein, 6 aa, Homo sapiens
QSIGSW

SEQ ID NO: 194 - protein, 17 aa, Homo sapiens
LAWYQQKPGKAPKLLIY

SEQ ID NO: 195 - skipped

SEQ ID NO: 196 - protein, 36 aa, Homo sapiens; identical to SEQ ID NO: 56

SEQ ID NO: 197 - protein, 9 aa, Homo sapiens
QQHNSYSGA

SEQ ID NO: 198 - DNA, 483 bp, Homo sapiens
gacatccagatgacccagtctccttccacgctgtctgcatctgtaggagacagagtcaccatcacttgccgggccagtcagagtattggtagctggttggcctggtatcagcagaaaccagggaaagcccctaagctcctaatctataaggcgtctactttagaaagtggggtcccatcaaggttcagcggcagtggatctgggacagaattcactctcaccatcagcagcctgcagcctgatgatcttgcaacttattactgccaacagcataatagttattcgggggcgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggag

SEQ ID NO: 199 - protein, 107 aa, Homo sapiens
DIQMTQSPSTLSASVGDRVTITCRASQSIGSWLAWYQQKPGKAPKLLIYKASTLESGVPSRFSGSGSGTEFTLTISSLQPDDLATYYCQQHNSYSGAFGQGTKVEIK

SEQ ID NO: 200 - protein, 10 aa, Homo sapiens
FGQGTKVEIK

SEQ ID NO: 201 - protein, 98 aa, Homo sapiens
EVQLLESGGGLVQPGGSLRLSCEASGFTFISYAMSWVRQAPGKGLEWVSVISGSGGARYYADSVKGRFTISRDNSKNTLYLEMNNVRAEDTAVYFCAK

SEQ ID NO: 202 - protein, 25 aa, Homo sapiens
EVQLLESGGGLVQPGGSLRLSCEAS

SEQ ID NO: 203 - protein, 8 aa, Homo sapiens
GFTFISYA

SEQ ID NO: 204 - protein, 17 aa, Homo sapiens
MSWVRQAPGKGLEWVSV

SEQ ID NO: 205 - protein, 8 aa, Homo sapiens
ISGSGGAR

SEQ ID NO: 206 - protein, 38 aa, Homo sapiens
YYADSVKGRFTISRDNSKNTLYLEMNNVRAEDTAVYFC

SEQ ID NO: 207 - protein, 15 aa, Homo sapiens
AKDRILPYDTDAFDI

SEQ ID NO: 208 - DNA, 480 bp, Homo sapiens
gaggtgcagctgttggagtctgggggaggcttggtgcagccgggggggtccctgagactctcctgtgaagcctctggattcacctttatcagttatgccatgagttgggtccgccaggctccagggaaggggctggagtgggtctcagttattagtgggagcggtggtgccagatactacgcagactccgtgaagggccggttcaccatctccagagacaattccaagaacaccctatatctggaaatgaacaacgtgagagccgaagacacggccgtatatttttgtgcgaaagatcgaattctcccatatgacaccgatgcctttgacatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacg

SEQ ID NO: 209 - protein, 122 aa, Homo sapiens
EVQLLESGGGLVQPGGSLRLSCEASGFTFISYAMSWVRQAPGKGLEWVSVISGSGGARYYADSVKGRFTISRDNSKNTLYLEMNNVRAEDTAVYFCAKDRILPYDTDAFDIWGQGTMVTVSS

SEQ ID NO: 210 - protein, 11 aa, Homo sapiens
WGQGTMVTVSS

SEQ ID NO: 211 - protein, 94 aa, Homo sapiens
DIQMTQSPSTLSASVGDRVTITCRASESVSVSLAWYQQKPGKAPKLLIYKASTLESGVPPRFSGSGSGTEFTLTISSLQPNDFATYYCQEYHTS

SEQ ID NO: 212 - protein, 26 aa, Homo sapiens
DIQMTQSPSTLSASVGDRVTITCRAS

SEQ ID NO: 213 - protein, 6 aa, Homo sapiens
ESVSVS

SEQ ID NO: 214 - protein, 17 aa, Homo sapiens
LAWYQQKPGKAPKLLIY

SEQ ID NO: 215 - skipped

SEQ ID NO: 216 - protein, 36 aa, Homo sapiens
TLESGVPPRFSGSGSGTEFTLTISSLQPNDFATYYC

SEQ ID NO: 217 - protein, 10 aa, Homo sapiens
QEYHTSSRVT

SEQ ID NO: 218 - DNA, 483 bp, Homo sapiens
gacatccagatgacccagtctccttccaccctgtctgcgtctgtgggagacagagtcaccatcacttgccgggccagtgagagtgttagtgtctcgttggcctggtatcagcagaaaccgggcaaagcccctaaactcctaatctataaggcgtctactttagaaagtggcgtcccacccaggttcagcggcagtggatctgggacagaattcactctcaccattagcagcctgcagcctaatgactttgcgacttattactgccaagaatatcacacttcttcgcgggtcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccag

SEQ ID NO: 219 - protein, 108 aa, Homo sapiens
DIQMTQSPSTLSASVGDRVTITCRASESVSVSLAWYQQKPGKAPKLLIYKASTLESGVPPRFSGSGSGTEFTLTISSLQPNDFATYYCQEYHTSSRVTFGPGTKVDIK

SEQ ID NO: 220 - protein, 10 aa, Homo sapiens
FGPGTKVDIK

SEQ ID NO: 221 - protein, 98 aa, Homo sapiens
EVQLLESGGGLVQPGASLRLSCAASGFSFKDYALSWVRQAPGKGLEWVSHISGSGLSTYYADSVKGRFTISRDNSKNTVYLQMNSLRAEDTAVYFCAK

SEQ ID NO: 222 - protein, 25 aa, Homo sapiens
EVQLLESGGGLVQPGASLRLSCAAS

SEQ ID NO: 223 - protein, 8 aa, Homo sapiens
GFSFKDYA

SEQ ID NO: 224 - protein, 17 aa, Homo sapiens
LSWVRQAPGKGLEWVSH

SEQ ID NO: 225 - protein, 8 aa, Homo sapiens
ISGSGLST

SEQ ID NO: 226 - protein, 38 aa, Homo sapiens
YYADSVKGRFTISRDNSKNTVYLQMNSLRAEDTAVYFC

SEQ ID NO: 227 - protein, 16 aa, Homo sapiens
AKDRVVGRPWEYSLDF

SEQ ID NO: 228 - DNA, 480 bp, Homo sapiens
gaggtgcagctgttggagtctgggggaggcctggtgcagcctggggcgtccctgagactctcctgtgcagcctctggattcagctttaaggactatgccctgagctgggtccgccaggctccagggaaggggctggagtgggtctcacatattagtggtagtggtcttagtacatactacgcagactccgtcaagggccggttcaccatctccagagacaattccaagaacaccgtgtatttgcaaatgaacagcttgagagccgaggacacggccgtgtatttctgtgcgaaagatcgggtagtaggtcgcccctgggagtactcccttgacttctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtg

SEQ ID NO: 229 - protein, 123 aa, Homo sapiens
EVQLLESGGGLVQPGASLRLSCAASGFSFKDYALSWVRQAPGKGLEWVSHISGSGLSTYYADSVKGRFTISRDNSKNTVYLQMNSLRAEDTAVYFCAKDRVVGRPWEYSLDFWGQGTLVTVSS

SEQ ID NO: 230 - protein, 11 aa, Homo sapiens
WGQGTLVTVSS

SEQ ID NO: 231 - protein, 95 aa, Homo sapiens
EIVMTQSPATVSVSPGERATLSCRASQSVNSDLVWYQQKPGQAPRLLIYGASIRATGIPARFSGSGSGTEFTLTISSIQSEDFAVYYCQQYNNWP

SEQ ID NO: 232 - protein, 26 aa, Homo sapiens
EIVMTQSPATVSVSPGERATLSCRAS

SEQ ID NO: 233 - protein, 6 aa, Homo sapiens
QSVNSD

SEQ ID NO: 234 - protein, 17 aa, Homo sapiens
LVWYQQKPGQAPRLLIY

SEQ ID NO: 235 - skipped

SEQ ID NO: 236 - protein, 36 aa, Homo sapiens
IRATGIPARFSGSGSGTEFTLTISSIQSEDFAVYYC

SEQ ID NO: 237 - protein, 10 aa, Homo sapiens
QQYNNWPPLT

SEQ ID NO: 238 - DNA, 483 bp, Homo sapiens
gaaatagtgatgacgcagtctccagccaccgtgtctgtgtctccaggggaaagagccaccctctcttgcagggccagtcagagtgttaacagcgacctcgtatggtaccagcagaaacctggccaggctcccagactcctcatttatggagcgtccattagggccactggtatcccagccaggttcagtggcagtgggtctgggacagagttcactctcaccatcagcagcattcagtctgaagattttgcagtttattactgtcagcagtataataactggcctccgctcactttcggcggagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccag

SEQ ID NO: 239 - protein, 108 aa, Homo sapiens
EIVMTQSPATVSVSPGERATLSCRASQSVNSDLVWYQQKPGQAPRLLIYGASIRATGIPARFSGSGSGTEFTLTISSIQSEDFAVYYCQQYNNWPPLTFGGGTKVEIK

SEQ ID NO: 240 - protein, 10 aa, Homo sapiens
FGGGTKVEIK

SEQ ID NO: 241 - protein, 96 aa, Homo sapiens
EVQLVESGGGLVQPGGSLRLSCAASGFSVSSNFMSWVRQTPGKGLEWVSVLYSGGATFYADSVKGRFTISRDNSKNTLYLQMDSLRVEDTGVYYCA

SEQ ID NO: 242 - protein, 25 aa, Homo sapiens [sequence omitted]

SEQ ID NO: 243 - protein, 8 aa, Homo sapiens
GFSVSSNF

SEQ ID NO: 244 - protein, 17 aa, Homo sapiens
MSWVRQTPGKGLEWVSV

SEQ ID NO: 245 - protein, 7 aa, Homo sapiens
LYSGGAT

SEQ ID NO: 246 - protein, 38 aa, Homo sapiens
FYADSVKGRFTISRDNSKNTLYLQMDSLRVEDTGVYYC

SEQ ID NO: 247 - protein, 11 aa, Homo sapiens
ASRHYNYDDDY

SEQ ID NO: 248 - DNA, 480 bp, Homo sapiens
gaggtgcagctggtggagtctgggggaggcttggtccagcctggggggtccctgagactctcctgtgcagcctctggattcagcgtcagtagcaacttcatgagttgggtccgccagactccagggaaggggctggagtgggtctcagttctttatagcggtggtgccacattctacgcagactccgtgaagggcagattcaccatctccagagacaattcgaagaacacgctgtatcttcaaatggacagcctgagagtcgaggacacgggtgtgtattactgtgcgagcagacactacaattacgacgatgactacgggggccagggaacactggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactca

SEQ ID NO: 249 - protein, 117 aa, Homo sapiens
EVQLVESGGGLVQPGGSLRLSCAASGFSVSSNFMSWVRQTPGKGLEWVSVLYSGGATFYADSVKGRFTISRDNSKNTLYLQMDSLRVEDTGVYYCASRHYNYDDDYGGQGTLVTVSS

SEQ ID NO: 250 - protein, 11 aa, Homo sapiens
GGQGTLVTVSS

SEQ ID NO: 251 - protein, 99 aa, Homo sapiens
DVVMTQSPLSLPVTLGQPASISCRSSQSLVHSDGNTYLNWFQQRPGQSLRRLIYKVSNRDSGVPDRFSGSGSGTDFTLKISRVEAEDVGVYYCMQGTHW

SEQ ID NO: 252 - protein, 26 aa, Homo sapiens
DVVMTQSPLSLPVTLGQPASISCRSS

SEQ ID NO: 253 - protein, 11 aa, Homo sapiens
QSLVHSDGNTY

SEQ ID NO: 254 - protein, 17 aa, Homo sapiens
LNWFQQRPGQSLRRLIY

SEQ ID NO: 255 - skipped

SEQ ID NO: 256 - protein, 36 aa, Homo sapiens
NRDSGVPDRFSGSGSGTDFTLKISRVEAEDVGVYYC

SEQ ID NO: 257 - protein, 8 aa, Homo sapiens
MQGTHWPT

SEQ ID NO: 258 - DNA, 483 bp, Homo sapiens
gatgttgtgatgactcagtctccactctccctgcccgtcacccttggacagccggcctccatctcctgcaggtctagtcaaagcctcgtacacagtgatggaaacacctacttgaattggtttcagcagaggccaggccaatctctaaggcgcctaatttataaggtttctaaccgggactctggggtcccagacagattcagcggcagtgggtcaggcactgacttcacactgaaaatcagcagggtggaggctgaggatgttggggtttattactgcatgcaaggtacacactggcccaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggt

SEQ ID NO: 259 - protein, 111 aa, Homo sapiens
DVVMTQSPLSLPVTLGQPASISCRSSQSLVHSDGNTYLNWFQQRPGQSLRRLIYKVSNRDSGVPDRFSGSGSGTDFTLKISRVEAEDVGVYYCMQGTHWPTFGQGTRLEIK

SEQ ID NO: 260 - protein, 10 aa, Homo sapiens
FGQGTRLEIK

SEQ ID NO: 261 - protein, 98 aa, Homo sapiens
EVQLVESGGTVVQPGGSLRLSCVASEYTFRNYWMSWVRQAPGKGLEWVGNINQDGSEKYYVDSVKGRFTISRDNAENSLFLQMNSLRVADTAVYYCAR

SEQ ID NO: 262 - protein, 25 aa, Homo sapiens
EVQLVESGGTVVQPGGSLRLSCVAS

SEQ ID NO: 263 - protein, 8 aa, Homo sapiens
EYTFRNYW

SEQ ID NO: 264 - protein, 17 aa, Homo sapiens
MSWVRQAPGKGLEWVGN

SEQ ID NO: 265 - protein, 8 aa, Homo sapiens
INQDGSEK

SEQ ID NO: 266 - protein, 38 aa, Homo sapiens
YYVDSVKGRFTISRDNAENSLFLQMNSLRVADTAVYYC

SEQ ID NO: 267 - protein, 18 aa, Homo sapiens
ARAGSYGDYRPINNWFDP

SEQ ID NO: 268 - DNA, 559 bp, Homo sapiens
gaggtgcagctggtggagtctgggggaaccgtggtccagccgggggggtccctgagactctcctgtgtagcctctgaatataccttcaggaattattggatgagctgggtccgccaggctccagggaaggggctggagtgggtgggcaacataaatcaagatggaagtgagaagtactatgtggactctgtgaagggccgattcaccatctccagagacaacgccgagaactccctatttctgcaaatgaacagcctgagagtcgcggacacggctgtttattactgtgcgagagcggggagttacggtgactacaggccgataaacaactggttcgacccctggggccggggaaccctggtcaccgtctcctcagcgtcgaccaagggcccatcggtcttccccctggcaccctcctccaagagcacctctgggggcacagcggccctgagctgcctggtcaaggactacttccccgaacctgtgacggtctcgtggaactcaggcgccctgaccagcggcgtgcacaccttcccggctgtcctacagtcctcaggac

SEQ ID NO: 269 - protein, 125 aa, Homo sapiens
EVQLVESGGTVVQPGGSLRLSCVASEYTFRNYWMSWVRQAPGKGLEWVGNINQDGSEKYYVDSVKGRFTISRDNAENSLFLQMNSLRVADTAVYYCARAGSYGDYRPINNWFDPWGRGTLVTVSS

SEQ ID NO: 270 - protein, 11 aa, Homo sapiens
WGRGTLVTVSS

SEQ ID NO: 271 - protein, 94 aa, Homo sapiens
DIQMTQSPSTLSASVGGRVTITCRASQSISFSLAWYQQKPGKAPELVIYQTSNLKSGVPSRFSGSGSGTQFTLTISSLQPEDFATYYCQHYSNY

SEQ ID NO: 272 - protein, 26 aa, Homo sapiens
DIQMTQSPSTLSASVGGRVTITCRAS

SEQ ID NO: 273 - protein, 6 aa, Homo sapiens
QSISFS

SEQ ID NO: 274 - protein, 17 aa, Homo sapiens
LAWYQQKPGKAPELVIY

SEQ ID NO: 275 - skipped

SEQ ID NO: 276 - protein, 36 aa, Homo sapiens
NLKSGVPSRFSGSGSGTQFTLTISSLQPEDFATYYC

SEQ ID NO: 277 - protein, 9 aa, Homo sapiens
QHYSNYSYT

SEQ ID NO: 278 - DNA, 485 bp, Homo sapiens
gacatccagatgacccagtctccttccaccctgtctgcatctgtagggggcagagtcaccatcacttgccgggccagtcagagtattagtttctcgttggcctggtatcagcagaaaccagggaaagcccctgaactcgtcatctatcagacgtctaatttaaaaagtggggtcccatcaagattcagcggcagtggctctgggacacaattcactctcaccatcagcagcctgcagcctgaagattttgcaacctattactgccaacactattctaattactcgtacacttttggccaggggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagag

SEQ ID NO: 279 - protein, 107 aa, Homo sapiens
DIQMTQSPSTLSASVGGRVTITCRASQSISFSLAWYQQKPGKAPELVIYQTSNLKSGVPSRFSGSGSGTQFTLTISSLQPEDFATYYCQHYSNYSYTFGQGTKVEIK

SEQ ID NO: 280 - protein, 10 aa, Homo sapiens
FGQGTKVEIK

SEQ ID NO: 281 - protein, 98 aa, Homo sapiens
QVQLVESGGGVVQPGRSLRLSCAASGFTFRIYAMHWVRQAPGKGLEWVAVISNEGTNKYYADSVKGRFTISRDNSKNTLYLQMNSLRPEDAAVYYCAR

SEQ ID NO: 282 - protein, 25 aa, Homo sapiens
QVQLVESGGGVVQPGRSLRLSCAAS

SEQ ID NO: 283 - protein, 8 aa, Homo sapiens
GFTFRIYA

SEQ ID NO: 284 - protein, 17 aa, Homo sapiens
MHWVRQAPGKGLEWVAV

SEQ ID NO: 285 - protein, 8 aa, Homo sapiens
ISNEGTNK

SEQ ID NO: 286 - protein, 38 aa, Homo sapiens
YYADSVKGRFTISRDNSKNTLYLQMNSLRPEDAAVYYC

SEQ ID NO: 287 - protein, 15 aa, Homo sapiens
ARDPSNPPHWGNFDS

SEQ ID NO: 288 - DNA, 480 bp, Homo sapiens
caggtgcagctggtggagtctgggggtggcgtggtccagcctgggaggtccctgagactctcctgtgcagcctctggattcaccttcagaatctatgctatgcactgggtccggcaggctccaggcaaggggctggagtgggtggcagttatatcaaatgaaggaactaataaatactacgcagactccgtgaagggccgattcaccatttccagagacaattccaagaacacgttgtatttgcaaatgaatagcctgagacctgaggacgcggctgtgtattactgtgcgagagatccctctaatcccccgcactgggggaactttgactcttggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacg

SEQ ID NO: 289 - protein, 122 aa, Homo sapiens
QVQLVESGGGVVQPGRSLRLSCAASGFTFRIYAMHWVRQAPGKGLEWVAVISNEGTNKYYADSVKGRFTISRDNSKNTLYLQMNSLRPEDAAVYYCARDPSNPPHWGNFDSWGQGTLVTVSS

SEQ ID NO: 290 - protein, 11 aa, Homo sapiens
WGQGTLVTVSS

SEQ ID NO: 291 - protein, 95 aa, Homo sapiens
EIVLTQSPGTLSLSPGERATLSCRASESVSSYLAWYQKKPGQAPRLLIYDASHRATGIPARFSGSGSGTDFTLTISSLESEDFGVYYCQQRSNWP

SEQ ID NO: 292 - protein, 26 aa, Homo sapiens [sequence omitted]

SEQ ID NO: 293 - protein, 6 aa, Homo sapiens
ESVSSY

SEQ ID NO: 294 - protein, 17 aa, Homo sapiens
LAWYQKKPGQAPRLLIY

SEQ ID NO: 295 - skipped

SEQ ID NO: 296 - protein, 36 aa, Homo sapiens
HRATGIPARFSGSGSGTDFTLTISSLESEDFGVYYC

SEQ ID NO: 297 - protein, 10 aa, Homo sapiens
QQRSNWPPIT

SEQ ID NO: 298 - DNA, 483 bp, Homo sapiens
gaaattgtgttgacacagtctccaggcaccctgtctctgtctccaggggaaagagccaccctctcctgccgggccagtgagagtgttagcagctacttagcctggtaccaaaagaaacctggccaggctcccaggctcctcatctatgatgcatcccacagggccactggcatcccagccaggttcagtggcagtgggtctgggacagacttcactctcaccatcagcagcctagagtctgaagattttggagtttattactgtcagcagcgtagcaactggcctccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccag

SEQ ID NO: 299 - protein, 108 aa, Homo sapiens
EIVLTQSPGTLSLSPGERATLSCRASESVSSYLAWYQKKPGQAPRLLIYDASHRATGIPARFSGSGSGTDFTLTISSLESEDFGVYYCQQRSNWPPITFGQGTRLEIK

SEQ ID NO: 300 - protein, 10 aa, Homo sapiens
FGQGTRLEIK

SEQ ID NO: 301 - protein, 98 aa, Homo sapiens
EVQLLESGGGLIQPGGSLRLSCAASAFTFNKYAMNWVRQAPGKGLEWVSHISGSGLSTYYADSVKGRFTISRDNSKNTLYLQMNSLRAEDTAVYYCAK

SEQ ID NO: 302 - protein, 25 aa, Homo sapiens
EVQLLESGGGLIQPGGSLRLSCAAS

SEQ ID NO: 303 - protein, 8 aa, Homo sapiens
AFTFNKYA

SEQ ID NO: 304 - protein, 17 aa, Homo sapiens
MNWVRQAPGKGLEWVSH

SEQ ID NO: 305 - protein, 8 aa, Homo sapiens
ISGSGLST

SEQ ID NO: 306 - protein, 38 aa, Homo sapiens
YYADSVKGRFTISRDNSKNTLYLQMNSLRAEDTAVYYC

SEQ ID NO: 307 - protein, 16 aa, Homo sapiens
AKDLAVTPPAQGYLDR

SEQ ID NO: 308 - DNA, 481 bp, Homo sapiens
gaggtgcagctgttggagtctgggggaggcttgatacagccgggggggtccctgagactctcctgtgcagcctctgcattcacatttaacaaatatgccatgaactgggtccgccaggctccagggaaggggctggagtgggtctcgcatattagtggcagtggtcttagcacatactacgcagactccgtgaagggccggttcaccatctccagagacaattccaagaacacgctgtatctgcaaatgaacagcctgagagccgaggacacggccgtctactactgtgcgaaagatctcgccgttacaccacctgcccagggttacttggaccgctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtga

SEQ ID NO: 309 - protein, 123 aa, Homo sapiens
EVQLLESGGGLIQPGGSLRLSCAASAFTFNKYAMNWVRQAPGKGLEWVSHISGSGLSTYYADSVKGRFTISRDNSKNTLYLQMNSLRAEDTAVYYCAKDLAVTPPAQGYLDRWGQGTLVTVSS

SEQ ID NO: 310 - protein, 11 aa, Homo sapiens
WGQGTLVTVSS

SEQ ID NO: 311 - protein, 95 aa, Homo sapiens
EIVLTQSPATLSLSPGERATLSCRASQSVNNYLAWYQEKPGQAPRLLIYDASNRATGIPARFSGSGSGTDFTLTISSLEPEDFAVYYCQQRSNWP

SEQ ID NO: 312 - protein, 26 aa, Homo sapiens [sequence omitted]

SEQ ID NO: 313 - protein, 6 aa, Homo sapiens
QSVNNY

SEQ ID NO: 314 - protein, 17 aa, Homo sapiens
LAWYQEKPGQAPRLLIY

SEQ ID NO: 315 - skipped

SEQ ID NO: 316 - protein, 36 aa, Homo sapiens [sequence omitted]

SEQ ID NO: 317 - protein, 10 aa, Homo sapiens
QQRSNWPPIT

SEQ ID NO: 318 - DNA, 485 bp, Homo sapiens
gaaattgtgttgacacagtctccagccaccctgtctttgtctccaggggaaagagccaccctctcctgcagggccagtcagagtgttaacaactacttagcctggtaccaagagaagcctggccaggctcccaggctcctcatctatgatgcatccaacagggccactggcatcccagccaggttcagtggcagtgggtctgggacagacttcactctcaccatcagcagcctagaacctgaagattttgcagtttattactgtcagcagcgtagcaactggcctccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccagga

SEQ ID NO: 319 - protein, 108 aa, Homo sapiens
EIVLTQSPATLSLSPGERATLSCRASQSVNNYLAWYQEKPGQAPRLLIYDASNRATGIPARFSGSGSGTDFTLTISSLEPEDFAVYYCQQRSNWPPITFGQGTRLEIK

SEQ ID NO: 320 - protein, 10 aa, Homo sapiens
FGQGTRLEIK

SEQ ID NO: 321 - protein, 98 aa, Homo sapiens
QVQLVQSGAEVRKPGSSVKVSCTTSGGTFGSYGFNWVRQAPGQGLEWMGRIFPLLGTANYAQRFQGRVTITADKSTTTAYMELSRLTSEDTAVYYCAR

SEQ ID NO: 322 - protein, 25 aa, Homo sapiens
QVQLVQSGAEVRKPGSSVKVSCTTS

SEQ ID NO: 323 - protein, 8 aa, Homo sapiens
GGTFGSYG

SEQ ID NO: 324 - protein, 17 aa, Homo sapiens
FNWVRQAPGQGLEWMGR

SEQ ID NO: 325 - protein, 8 aa, Homo sapiens
IFPLLGTA

SEQ ID NO: 326 - protein, 38 aa, Homo sapiens
NYAQRFQGRVTITADKSTTTAYMELSRLTSEDTAVYYC

SEQ ID NO: 327 - protein, 17 aa, Homo sapiens
ARDDYMTVDRDYYYMDV

SEQ ID NO: 328 - DNA, 561 bp, Homo sapiens
caggtccagctggtgcagtctggggctgaggtgaggaagcctgggtcctcggtgaaggtctcctgtacgacctctggaggcaccttcggcagttatggttttaattgggtgcgacaggcccctggacaagggcttgagtggatgggaaggatcttccctctcctggggactgcaaactatgcacagcgcttccagggcagagtcacgattaccgcggacaaatccacgaccacagcctacatggagctgagcaggctgacatctgaggacacggccgtgtattattgtgcgagagatgactatatgacagtggaccgagactactactacatggacgtctggggcaaagggacctcggtcaccgtctcctcagcctccaccaagggcccatcggtcttccccctggcaccctcctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctac

SEQ ID NO: 329 - protein, 124 aa, Homo sapiens
QVQLVQSGAEVRKPGSSVKVSCTTSGGTFGSYGFNWVRQAPGQGLEWMGRIFPLLGTANYAQRFQGRVTITADKSTTTAYMELSRLTSEDTAVYYCARDDYMTVDRDYYYMDVWGKGTSVTVSS

SEQ ID NO: 330 - protein, 11 aa, Homo sapiens
WGKGTSVTVSS

SEQ ID NO: 331 - protein, 95 aa, Homo sapiens
EIVLTQSPATLSVSPGERATLSCRASQSISTNLAWYQQKPGQAPRLLIYGASTRATGIPARFSGSGSGTEFTLTVSSLQSEDFAVYYCQQYNNWP

SEQ ID NO: 332 - protein, 26 aa, Homo sapiens
EIVLTQSPATLSVSPGERATLSCRAS

SEQ ID NO: 333 - protein, 6 aa, Homo sapiens
QSISTN

SEQ ID NO: 334 - protein, 17 aa, Homo sapiens
LAWYQQKPGQAPRLLIY

SEQ ID NO: 335 - skipped

SEQ ID NO: 336 - protein, 36 aa, Homo sapiens
TRATGIPARFSGSGSGTEFTLTVSSLQSEDFAVYYC

SEQ ID NO: 337 - protein, 11 aa, Homo sapiens
QQYNNWPPLFS

SEQ ID NO: 338 - DNA, 484 bp, Homo sapiens
gaaattgtgctgacacagtctccagccaccctgtctgtgtctccaggggaaagagccaccctctcctgcagggccagtcagagtattagcaccaacttagcctggtaccagcaaaaacctggccaggctcccaggctcctcatctatggtgcgtcgaccagggccactggtatcccagccaggttcagtggcagtgggtctgggacagagttcactctcaccgtcagcagcctgcagtctgaagactttgcagtttattactgtcagcagtataataattggcctcccctattcagtttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactccc

SEQ ID NO: 339 - protein, 109 aa, Homo sapiens
EIVLTQSPATLSVSPGERATLSCRASQSISTNLAWYQQKPGQAPRLLIYGASTRATGIPARFSGSGSGTEFTLTVSSLQSEDFAVYYCQQYNNWPPLFSFGPGTKVDIK

SEQ ID NO: 340 - protein, 10 aa, Homo sapiens
FGPGTKVDIK

SEQ ID NO: 341 - protein, 98 aa, Homo sapiens
EVQLVESGRGLVHPGGSLRLSCAASGFTFSSYSMSWVRQAPGKGLEWLATINKEGSENHHVDYAKGRFTISRDNAKNTLYLQMNSLRAEDTAVYYCAR

SEQ ID NO: 342 - protein, 25 aa, Homo sapiens
EVQLVESGRGLVHPGGSLRLSCAAS

SEQ ID NO: 343 - protein, 8 aa, Homo sapiens
GFTFSSYS

SEQ ID NO: 344 - protein, 17 aa, Homo sapiens
MSWVRQAPGKGLEWLAT

SEQ ID NO: 345 - protein, 8 aa, Homo sapiens
INKEGSEN

SEQ ID NO: 346 - protein, 38 aa, Homo sapiens
HHVDYAKGRFTISRDNAKNTLYLQMNSLRAEDTAVYYC

SEQ ID NO: 347 - protein, 22 aa, Homo sapiens
ARVSREEWATVDDPHDYYYMDV

SEQ ID NO: 348 - DNA, 560 bp, Homo sapiens
gaggtgcagctggtggagtctgggagaggcttggtccaccctggggggtccctgagactctcctgtgcagcctctggattcacctttagtagttattcgatgagttgggtccgccaggctccagggaaggggctggagtggctggccaccataaacaaagagggaagtgaaaaccaccatgtggactacgcgaagggccggttcactatctccagagacaatgccaagaataccctgtatctacaaatgaatagtctgagagccgaggacacggctgtgtattattgtgcgagagtctccagggaagagtgggcgacagttgacgaccctcacgactactactacatggacgtatggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctaca

SEQ ID NO: 349 - protein, 129 aa, Homo sapiens
EVQLVESGRGLVHPGGSLRLSCAASGFTFSSYSMSWVRQAPGKGLEWLATINKEGSENHHVDYAKGRFTISRDNAKNTLYLQMNSLRAEDTAVYYCARVSREEWATVDDPHDYYYMDVWGQGTTVTVSS

SEQ ID NO: 350 - protein, 11 aa, Homo sapiens
WGQGTTVTVSS

SEQ ID NO: 351 - protein, 94 aa, Homo sapiens
DIQMTQSPSSLSASVGDRVTITCRASQRISNYLNWYQQNPGRAPKLLIYKAYNLERGVPSRFSGSGSGTDFTLTISTLQPEDFGTYYCQQNYNP

SEQ ID NO: 352 - protein, 26 aa, Homo sapiens [sequence omitted]

SEQ ID NO: 353 - protein, 6 aa, Homo sapiens
QRISNY

SEQ ID NO: 354 - protein, 17 aa, Homo sapiens
LNWYQQNPGRAPKLLIY

SEQ ID NO: 355 - skipped

SEQ ID NO: 356 - protein, 36 aa, Homo sapiens
NLERGVPSRFSGSGSGTDFTLTISTLQPEDFGTYYC

SEQ ID NO: 357 - protein, 9 aa, Homo sapiens
QQNYNPLFT

SEQ ID NO: 358 - DNA, 484 bp, Homo sapiens
gacatccagatgacccagtctccatcctccctgtctgcatctgtgggagacagagtcaccatcacttgccgggcaagtcagaggattagcaactacttaaattggtatcagcagaacccaggcagagcccctaaactcctgatctataaagcatacaatttagaaaggggagtcccgtcaaggttcagtggcagtggatctgggacagatttcactctcaccatcagcactctgcaacctgaagattttggtacttactactgtcaacagaattacaatcccctgttcactttcggcggggggaccaaggtagagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggaga

SEQ ID NO: 359 - protein, 107 aa, Homo sapiens
DIQMTQSPSSLSASVGDRVTITCRASQRISNYLNWYQQNPGRAPKLLIYKAYNLERGVPSRFSGSGSGTDFTLTISTLQPEDFGTYYCQQNYNPLFTFGGGTKVEIK

SEQ ID NO: 360 - protein, 10 aa, Homo sapiens
FGGGTKVEIK

SEQ ID NO: 361 - protein, 98 aa, Homo sapiens
EVQLVQSGGGLVQPGGSLRLSCAASGFTFSSYAMSWVRQAPGKGPQWVANIKKEGGEKQEMDHVKGRFTISRDNAKNTLYLQMNSLRVEDTAVYYCVR

SEQ ID NO: 362 - protein, 25 aa, Homo sapiens
EVQLVQSGGGLVQPGGSLRLSCAAS

SEQ ID NO: 363 - protein, 8 aa, Homo sapiens
GFTFSSYA

SEQ ID NO: 364 - protein, 17 aa, Homo sapiens
MSWVRQAPGKGPQWVAN

SEQ ID NO: 365 - protein, 8 aa, Homo sapiens
IKKEGGEK

SEQ ID NO: 366 - protein, 38 aa, Homo sapiens
QEMDHVKGRFTISRDNAKNTLYLQMNSLRVEDTAVYYC

SEQ ID NO: 367 - protein, 22 aa, Homo sapiens
VRVSREEWATVDDPHDYYYMDV

SEQ ID NO: 368 - DNA, 367 bp, Homo sapiens
gaggtgcagctggtgcagtctgggggaggcttggtccagccgggggggtccctgagactctcctgtgcagcctctggattcacgtttagtagttacgcgatgagttgggtccgccaggctccagggaaggggccgcagtgggtggccaatataaagaaagaaggcggtgaaaagcaggaaatggaccatgtgaagggccggttcactatctccagagacaacgccaagaatacactgtatctgcaaatgaatagtctgagagtcgaggacacggctgtgtattactgtgtgagagtctccagggaagagtgggcgacagttgacgaccctcacgactactactacatggacgtctggggccaagggt

SEQ ID NO: 369 - protein, 122 aa, Homo sapiens
EVQLVQSGGGLVQPGGSLRLSCAASGFTFSSYAMSWVRQAPGKGPQWVANIKKEGGEKQEMDHVKGRFTISRDNAKNTLYLQMNSLRVEDTAVYYCVRVSREEWATVDDPHDYYYMDVWGQG

SEQ ID NO: 370 - protein, 4 aa, Homo sapiens
WGQG

SEQ ID NO: 371 - protein, 94 aa, Homo sapiens
DIQMTQSPSSLSASVGDRVTITCRASQRISNYLNWYQQKPGKAPKLLIYNANILENGVPSRFSGGGSGTDFTLSISGLQPEDFGTYYCQQSYNS

SEQ ID NO: 372 - protein, 26 aa, Homo sapiens [sequence omitted]

SEQ ID NO: 373 - protein, 6 aa, Homo sapiens
QRISNY

SEQ ID NO: 374 - protein, 17 aa, Homo sapiens
LNWYQQKPGKAPKLLIY

SEQ ID NO: 375 - skipped

SEQ ID NO: 376 - protein, 36 aa, Homo sapiens
ILENGVPSRFSGGGSGTDFTLSISGLQPEDFGTYYC

SEQ ID NO: 377 - protein, 9 aa, Homo sapiens
QQSYNSLFT

SEQ ID NO: 378 - DNA, 485 bp, Homo sapiens
gacatccagatgacgcagtctccatcctccctgtctgcatctgtaggagacagagtcaccatcacttgtcgggcaagtcagaggattagcaactacttaaattggtatcagcaaaaaccaggcaaagcccctaaactcctgatctataacgcaaacattttagagaatggggtcccatcaaggttcagtggcggtgggtctgggacagatttcactctctccatcagcggtctgcaacctgaagattttggtacttactactgtcaacagagttacaattccctgttcactttcggcggggggaccaaggtagagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagag

SEQ ID NO: 379 - protein, 107 aa, Homo sapiens
DIQMTQSPSSLSASVGDRVTITCRASQRISNYLNWYQQKPGKAPKLLIYNANILENGVPSRFSGGGSGTDFTLSISGLQPEDFGTYYCQQSYNSLFTFGGGTKVEIK

SEQ ID NO: 380 - protein, 10 aa, Homo sapiens
FGGGTKVEIK

SEQ ID NO: 381 - protein, 98 aa, Homo sapiens
EVQLVESGGGLVQPGGSLRLSCAASGFTFSSYSMTWVRQAPGKGLEWVANIEKEGSEKDHVGYVKGRFTISRDNAKSTLYLQMNSLSAEDTAVYYCAR

SEQ ID NO: 382 - protein, 25 aa, Homo sapiens [sequence omitted]

SEQ ID NO: 383 - protein, 8 aa, Homo sapiens
GFTFSSYS

SEQ ID NO: 384 - protein, 17 aa, Homo sapiens
MTWVRQAPGKGLEWVAN

SEQ ID NO: 385 - protein, 8 aa, Homo sapiens
IEKEGSEK

SEQ ID NO: 386 - protein, 38 aa, Homo sapiens
DHVGYVKGRFTISRDNAKSTLYLQMNSLSAEDTAVYYC

SEQ ID NO: 387 - protein, 22 aa, Homo sapiens
ARVSREEWATVDDPHDYYYMDV

SEQ ID NO: 388 - DNA, 478 bp, Homo sapiens
gaggtgcagctggtggagtctgggggaggcttggtccagcctggggggtccctgaggctctcctgtgcagcctctggattcacctttagtagttattcgatgacctgggtccgccaggctccagggaaggggctggagtgggtggccaatatagagaaagaaggaagtgagaaagaccatgtgggctatgtgaagggccgattcactatctccagagacaacgccaagagtacactgtatctgcaaatgaatagtctgagcgccgaggacacggctgtgtattactgtgcgagagtctccagggaagagtgggcgacagttgacgaccctcacgactactactacatggacgtctggggccaagggaccacggtcaccgtctcctcagcgtcgaccaagggcccatcggtcttccccctggcaccctcctccaagagcacctctgggggcacagcggccctgggctgcctggtcaagg

SEQ ID NO: 389 - protein, 129 aa, Homo sapiens
EVQLVESGGGLVQPGGSLRLSCAASGFTFSSYSMTWVRQAPGKGLEWVANIEKEGSEKDHVGYVKGRFTISRDNAKSTLYLQMNSLSAEDTAVYYCARVSREEWATVDDPHDYYYMDVWGQGTTVTVSS

SEQ ID NO: 390 - protein, 11 aa, Homo sapiens
WGQGTTVTVSS

SEQ ID NO: 391 - protein, 93 aa, Homo sapiens
DIQMTQSPFSLSASVGDRVTITCRAGQRISNYLNWYQQKPGKAPKLLIYNANTLQGGVPLRFSGSGSGTDFTLTISSLQPEDSGTYYCQQSYN

SEQ ID NO: 392 - protein, 26 aa, Homo sapiens
DIQMTQSPFSLSASVGDRVTITCRAG

SEQ ID NO: 393 - protein, 6 aa, Homo sapiens
QRISNY

SEQ ID NO: 394 - protein, 17 aa, Homo sapiens
LNWYQQKPGKAPKLLIY

SEQ ID NO: 395 - skipped

SEQ ID NO: 396 - protein, 36 aa, Homo sapiens
TLQGGVPLRFSGSGSGTDFTLTISSLQPEDSGTYYC

SEQ ID NO: 397 - protein, 9 aa, Homo sapiens
QQSYNRLFT

SEQ ID NO: 398 - DNA, 562 bp, Homo sapiens
gacatccagatgacccagtctccgttctccctgtctgcatctgtgggagacagagtcaccatcacttgccgggcaggtcagaggattagcaactacttaaattggtatcagcagaagccaggcaaagcccctaaactgctgatctataacgcaaacactttacaaggtggggtcccattaaggttcagtggcagtggatctgggacagatttcactctcaccatcagcagtctgcaacctgaagattctggtacttactactgtcaacagagttacaataggctgttcactttcggcggggggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgaga

SEQ ID NO: 399 - protein, 107 aa, Homo sapiens
DIQMTQSPFSLSASVGDRVTITCRAGQRISNYLNWYQQKPGKAPKLLIYNANTLQGGVPLRFSGSGSGTDFTLTISSLQPEDSGTYYCQQSYNRLFTFGGGTKVEIK

SEQ ID NO: 400 - protein, 10 aa, Homo sapiens
FGGGTKVEIK

SEQ ID NO: 401 - protein, 98 aa, Homo sapiens
QVQLVQSGAEVKKPGTSVKVSCKASGYIFSGSYIQWVRQAPGQGLEWMGRINPKTGNTNYAQKFQGRVTMTRDMSISTAYMELTRLSSDDTAVYYCAR

SEQ ID NO: 402 - protein, 25 aa, Homo sapiens
QVQLVQSGAEVKKPGTSVKVSCKAS

SEQ ID NO: 403 - protein, 8 aa, Homo sapiens
GYIFSGSY

SEQ ID NO: 404 - protein, 17 aa, Homo sapiens
IQWVRQAPGQGLEWMGR

SEQ ID NO: 405 - protein, 8 aa, Homo sapiens
INPKTGNT

SEQ ID NO: 406 - protein, 38 aa, Homo sapiens
NYAQKFQGRVTMTRDMSISTAYMELTRLSSDDTAVYYC

SEQ ID NO: 407 - protein, 16 aa, Homo sapiens
ARDFDYGDYRGSAFDI

SEQ ID NO: 408 - DNA, 480 bp, Homo sapiens
caggtgcagctggtgcagtctggggctgaggtaaagaagcctgggacctcagtgaaagtctcctgcaaggcttctggatacatcttctccggctcctatatccagtgggtacgacaggcccctgggcaagggcttgagtggatgggaaggatcaaccctaagactggtaatacaaattatgcacagaagtttcagggcagggtcaccatgaccagggacatgtccatcagcacagcctacatggagctgactaggctgagctctgacgacacggccgtgtattactgtgcgagagactttgattacggtgactaccgcggctctgcttttgatatctggggccaaggggcaatggtcaccgtctcttcagcgtcgaccaagggcccatcggtcttccccctggcaccctcctccaagagcacctctgggggcacagcggccctgggctgcctggtcaaggactacttccccgaacctgtg

SEQ ID NO: 409 - protein, 123 aa, Homo sapiens
QVQLVQSGAEVKKPGTSVKVSCKASGYIFSGSYIQWVRQAPGQGLEWMGRINPKTGNTNYAQKFQGRVTMTRDMSISTAYMELTRLSSDDTAVYYCARDFDYGDYRGSAFDIWGQGAMVTVSS

SEQ ID NO: 410 - protein, 11 aa, Homo sapiens
WGQGAMVTVSS

SEQ ID NO: 411 - protein, 90 aa, Homo sapiens
DIQMTQSPSSLSASVGDRVTITCQPSQDFSNYLNWYQQKPGKAPKLLIYDTSNLETGVPSRFSGSGAGTHFTLTINSLQPEDIATYYCQQ

SEQ ID NO: 412 - protein, 26 aa, Homo sapiens
DIQMTQSPSSLSASVGDRVTITCQPS

SEQ ID NO: 413 - protein, 6 aa, Homo sapiens
QDFSNY

SEQ ID NO: 414 - protein, 17 aa, Homo sapiens
LNWYQQKPGKAPKLLIY

SEQ ID NO: 415 - skipped

SEQ ID NO: 416 - protein, 36 aa, Homo sapiens
NLETGVPSRFSGSGAGTHFTLTINSLQPEDIATYYC

SEQ ID NO: 417 - protein, 5 aa, Homo sapiens
QQLNT

SEQ ID NO: 418 - DNA, 484 bp, Homo sapiens
gacatccagatgacccagtctccatcctccctgtctgcatctgttggtgacagagtcaccatcacttgccagccgagtcaggactttagcaactatttaaattggtatcagcagaaaccagggaaagcccctaagctcctgatctacgatacatccaatttggaaacaggggtcccatcaagattcagtggaagtggggctgggacacattttactctcaccatcaacagcctgcagcctgaagacattgcaacatattactgtcaacagttaaataccttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagc

SEQ ID NO: 419 - protein, 103 aa, Homo sapiens
DIQMTQSPSSLSASVGDRVTITCQPSQDFSNYLNWYQQKPGKAPKLLIYDTSNLETGVPSRFSGSGAGTHFTLTINSLQPEDIATYYCQQLNTFGPGTKVDIK

SEQ ID NO: 420 - protein, 10 aa, Homo sapiens
FGPGTKVDIK

SEQ ID NO: 421 - protein, 98 aa, Homo sapiens
QVQLVQSGAEVKRPGASVKVSCKAAGFTLNNLYIHWVRQAPGQGLEWMGRINPNSGITKYADKFRGRVTLTRDTSVNTAYMEVARLRSDDTAVYYCAR

SEQ ID NO: 422 - protein, 25 aa, Homo sapiens
QVQLVQSGAEVKRPGASVKVSCKAA

SEQ ID NO: 423 - protein, 8 aa, Homo sapiens
GFTLNNLY

SEQ ID NO: 424 - protein, 17 aa, Homo sapiens
IHWVRQAPGQGLEWMGR

SEQ ID NO: 425 - protein, 8 aa, Homo sapiens
INPNSGIT

SEQ ID NO: 426 - protein, 38 aa, Homo sapiens
KYADKFRGRVTLTRDTSVNTAYMEVARLRSDDTAVYYC

SEQ ID NO: 427 - protein, 17 aa, Homo sapiens
ARDIDTGDYRGADVLQM

SEQ ID NO: 428 - DNA, 479 bp, Homo sapiens
caggtgcagctggtgcagtctggggctgaggtgaagaggcccggggcctcagtgaaggtctcctgcaaggctgcgggattcacgttgaacaacctctacatacactgggtgcgacaggcccctggacagggacttgagtggatgggacggatcaaccctaacagtggaatcacaaagtatgcagacaagtttcggggcagggtcacgttgaccagggacacgtccgtcaacactgcctatatggaggtggcgcggctgcgatctgacgacacggccgtctattattgtgcgcgagacattgacaccggtgactaccgcggcgctgatgttctccaaatgtggggtcaagggacaatggtcaccgtctcttcagcgtcgaccaagggcccatcggtcttccccctggcaccctcctccaagagcacctctgggggcacagcggccctgggctgcctggtcaaggactacttccccgaacc

SEQ ID NO: 429 - protein, 124 aa, Homo sapiens
QVQLVQSGAEVKRPGASVKVSCKAAGFTLNNLYIHWVRQAPGQGLEWMGRINPNSGITKYADKFRGRVTLTRDTSVNTAYMEVARLRSDDTAVYYCARDIDTGDYRGADVLQMWGQGTMVTVSS

SEQ ID NO: 430 - protein, 11 aa, Homo sapiens
WGQGTMVTVSS

SEQ ID NO: 431 - protein, 90 aa, Homo sapiens
DIQMTQSPSSLSASVGDRVTITCQASQDFSNYLNWYQQKPGRAPKLLIYDASKLATGVPSRFSGHKSGADYTFTITSLQPEDIATYYCQQ

SEQ ID NO: 432 - protein, 26 aa, Homo sapiens
DIQMTQSPSSLSASVGDRVTITCQAS

SEQ ID NO: 433 - protein, 6 aa, Homo sapiens
QDFSNY

SEQ ID NO: 434 - protein, 17 aa, Homo sapiens
LNWYQQKPGRAPKLLIY

SEQ ID NO: 435 - skipped

SEQ ID NO: 436 - protein, 36 aa, Homo sapiens
KLATGVPSRFSGHKSGADYTFTITSLQPEDIATYYC

SEQ ID NO: 437 - protein, 5 aa, Homo sapiens
QQLYT

SEQ ID NO: 438 - DNA, 485 bp, Homo sapiens
gacatccagatgacccagtctccatcctccctgtctgcatctgtgggagacagagtcaccatcacttgccaggcgagtcaagacttcagtaattatctaaattggtatcaacagaaacctgggagagcccctaagctcctcatctacgatgcttccaaattggcaacaggggtcccatcgaggttcagtggacataaatctggggcagattataccttcaccatcaccagcctgcagcctgaagatattgcaacatattactgtcaacagttgtatactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagca

SEQ ID NO: 439 - protein, 103 aa, Homo sapiens
DIQMTQSPSSLSASVGDRVTITCQASQDFSNYLNWYQQKPGRAPKLLIYDASKLATGVPSRFSGHKSGADYTFTITSLQPEDIATYYCQQLYTFGPGTKVDIK

SEQ ID NO: 440 - protein, 10 aa, Homo sapiens
FGPGTKVDIK

SEQ ID NO: 441 - protein, 98 aa, Homo sapiens
EVQLVESGGGLVQPGGSLRLSCAASGFTFSSYSMSWVRQAPGKGLEWVANINKEGSEKNHVDFVKGRFTISRDNAKNTLSLQMNSLRAEDSAVYYCAR

SEQ ID NO: 442 - protein, 25 aa, Homo sapiens [sequence omitted]

SEQ ID NO: 443 - protein, 8 aa, Homo sapiens
GFTFSSYS

SEQ ID NO: 444 - protein, 17 aa, Homo sapiens
MSWVRQAPGKGLEWVAN

SEQ ID NO: 445 - protein, 8 aa, Homo sapiens
INKEGSEK

SEQ ID NO: 446 - protein, 38 aa, Homo sapiens
NHVDFVKGRFTISRDNAKNTLSLQMNSLRAEDSAVYYC

SEQ ID NO: 447 - protein, 22 aa, Homo sapiens
ARVSREEWATVDDPHDYYYMDV

SEQ ID NO: 448 - DNA, 478 bp, Homo sapiens
gaggtgcagctggtggagtctgggggaggcttggtccagcctggggggtccctgagactctcctgtgcagcctctggattcacctttagtagttattcgatgagctgggtccgccaggctccagggaaggggctggagtgggtggccaatataaataaagaaggaagtgaaaagaaccatgtggactttgtgaagggccggttcactatctccagagacaacgccaagaatacactgtcgctgcaaatgaatagtctgagagccgaagattcggctgtgtattactgtgcgagagtctccagggaagagtgggcgacagttgacgaccctcacgactactactacatggacgtctggggccaagggaccacggtcaccgtctcctcagcgtcgaccaagggcccatcggtcttccccctggcaccctcctccaagagcacctctgggggcacagcggccctgggctgcctggtcaagg

SEQ ID NO: 449 - protein, 129 aa, Homo sapiens
EVQLVESGGGLVQPGGSLRLSCAASGFTFSSYSMSWVRQAPGKGLEWVANINKEGSEKNHVDFVKGRFTISRDNAKNTLSLQMNSLRAEDSAVYYCARVSREEWATVDDPHDYYYMDVWGQGTTVTVSS

SEQ ID NO: 450 - protein, 11 aa, Homo sapiens
WGQGTTVTVSS

SEQ ID NO: 451 - protein, 94 aa, Homo sapiens
DIQMTQSPSSLSASVGDRVTITCRASQRISNYLNWYQQRPGEAPKLLIYNAYTLESGVPSRFSGSGSGTDFTLTISSLQPEDFATYYCQQSYIT

SEQ ID NO: 452 - protein, 26 aa, Homo sapiens [sequence omitted]

SEQ ID NO: 453 - protein, 6 aa, Homo sapiens
QRISNY

SEQ ID NO: 454 - protein, 17 aa, Homo sapiens
LNWYQQRPGEAPKLLIY

SEQ ID NO: 455 - skipped

SEQ ID NO: 456 - protein, 36 aa, Homo sapiens
TLESGVPSRFSGSGSGTDFTLTISSLQPEDFATYYC

SEQ ID NO: 457 - protein, 9 aa, Homo sapiens
QQSYITLFT

SEQ ID NO: 458 - DNA, 563 bp, Homo sapiens
gacatccagatgacccagtctccgtcctccctgtctgcatctgtaggagacagagtcaccatcacttgccgggcaagtcagaggattagcaactacttgaattggtatcagcagagaccaggcgaagcccctaaactcctgatctataacgcatacactttagaaagtggggtcccatcaaggttcagtggcagtggatctgggacagatttcactctcaccatcagcagtctgcaacctgaggattttgctacttactactgtcaacagagttacattaccctgttcactttcggcggggggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaa

SEQ ID NO: 459 - protein, 107 aa, Homo sapiens
DIQMTQSPSSLSASVGDRVTITCRASQRISNYLNWYQQRPGEAPKLLIYNAYTLESGVPSRFSGSGSGTDFTLTISSLQPEDFATYYCQQSYITLFTFGGGTKVEIK

SEQ ID NO: 460 - protein, 10 aa, Homo sapiens
FGGGTKVEIK

SEQ ID NO: 461 - protein, 98 aa, Homo sapiens
EVQLLESGGALLQPGGSLRLSCAASGFTFSSYAMSWVRQPPGKGLQWVSIMSGRGDTMQYADSVKGRFTISRDNSKNTLYLQMNSLRAEDTAIYYCAR

SEQ ID NO: 462 - protein, 25 aa, Homo sapiens
EVQLLESGGALLQPGGSLRLSCAAS

SEQ ID NO: 463 - protein, 8 aa, Homo sapiens
GFTFSSYA

SEQ ID NO: 464 - protein, 17 aa, Homo sapiens
MSWVRQPPGKGLQWVSI

SEQ ID NO: 465 - protein, 8 aa, Homo sapiens
MSGRGDTM

SEQ ID NO: 466 - protein, 38 aa, Homo sapiens
QYADSVKGRFTISRDNSKNTLYLQMNSLRAEDTAIYYC

SEQ ID NO: 467 - protein, 19 aa, Homo sapiens
AREEFTDTEMTITQGDFGY

SEQ ID NO: 468 - DNA, 480 bp, Homo sapiens
gaggtgcagctgttggagtctgggggagccttgctacagccgggggggtccctgagactctcctgtgcagcctctggattcacctttagcagctatgccatgagctgggtccgccagcctccagggaagggtctgcagtgggtctcaattatgagtggtaggggtgataccatgcagtacgcagactccgtgaagggccggttcaccatctccagagacaattccaagaacacactttatctgcaaatgaacagcctgagagccgaggacacggccatttattactgtgcgagagaggagtttaccgacacagagatgactataacccaaggggactttggctactggggccagggcaccctggtcaccgtctcctcagcgtcgaccaagggcccatcggtcttccccctggcaccctcctccaagagcacctctgggggcacagcggccctgggctgcctggtcaaggactacttcccc

SEQ ID NO: 469 - protein, 126 aa, Homo sapiens
EVQLLESGGALLQPGGSLRLSCAASGFTFSSYAMSWVRQPPGKGLQWVSIMSGRGDTMQYADSVKGRFTISRDNSKNTLYLQMNSLRAEDTAIYYCAREEFTDTEMTITQGDFGYWGQGTLVTVSS

SEQ ID NO: 470 - protein, 11 aa, Homo sapiens
WGQGTLVTVSS

SEQ ID NO: 471 - protein, 94 aa, Homo sapiens
DIQMTQSPSSLSASVGDRVTITCRASQSISVYLNWYQQKPGKAPKLLIYGASNLQSGVPSRFSGSGSETDFTLTISSLQPEDFATYYCQRSYIT

SEQ ID NO: 472 - protein, 26 aa, Homo sapiens [sequence omitted]

SEQ ID NO: 473 - protein, 6 aa, Homo sapiens
QSISVY

SEQ ID NO: 474 - protein, 17 aa, Homo sapiens
LNWYQQKPGKAPKLLIY

SEQ ID NO: 475 - skipped

SEQ ID NO: 476 - protein, 36 aa, Homo sapiens
NLQSGVPSRFSGSGSETDFTLTISSLQPEDFATYYC

SEQ ID NO: 477 - protein, 9 aa, Homo sapiens
QRSYITPFT

SEQ ID NO: 478 - DNA, 485 bp, Homo sapiens
gacatccagatgacccagtctccatcctccctgtctgcatctgtaggagacagagtcaccatcacttgccgggcaagtcagagcattagtgtctatttaaattggtatcaacaaaaaccagggaaagcccctaagctcctgatctatggtgcatccaatttgcaaagtggtgtcccatcaaggttcagtggcagtggatccgagacagatttcactctcaccatcagcagtctgcaacctgaagattttgcaacttactactgtcaacgcagttacatcactccattcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagag

SEQ ID NO: 479 - protein, 107 aa, Homo sapiens
DIQMTQSPSSLSASVGDRVTITCRASQSISVYLNWYQQKPGKAPKLLIYGASNLQSGVPSRFSGSGSETDFTLTISSLQPEDFATYYCQRSYITPFTFGPGTKVDIK

SEQ ID NO: 480 - protein, 10 aa, Homo sapiens
FGPGTKVDIK

SEQ ID NO: 481 - protein, 98 aa, Homo sapiens
QVQLVQSGSEVRKPGASVKVSCKASGFTFTDCFIHWVRQAPGQGLEWMGRINPSRGTTKYAEKFRGRVSMTRDMAINTAYMDMSRLQSDDTAVYYCAR

SEQ ID NO: 482 - protein, 25 aa, Homo sapiens
QVQLVQSGSEVRKPGASVKVSCKAS

SEQ ID NO: 483 - protein, 8 aa, Homo sapiens
GFTFTDCF

SEQ ID NO: 484 - protein, 17 aa, Homo sapiens
IHWVRQAPGQGLEWMGR

SEQ ID NO: 485 - protein, 8 aa, Homo sapiens
INPSRGTT

SEQ ID NO: 486 - protein, 38 aa, Homo sapiens
KYAEKFRGRVSMTRDMAINTAYMDMSRLQSDDTAVYYC

SEQ ID NO: 487 - protein, 17 aa, Homo sapiens
ARDIDSGDYRAADVFQI

SEQ ID NO: 488 - DNA, 479 bp, Homo sapiens
caggtgcagctggtgcagtctgggtctgaggtgaggaagcctggggcctcagtgaaggtctcctgcaaggcttctggattcacattcaccgactgctttatacactgggtgcgacaggcccctggacagggacttgagtggatgggtcggatcaatcctagtagaggaaccacaaaatatgcagagaaatttcggggccgggtctcgatgacccgggacatggccatcaacacagcctacatggacatgagcaggctgcaatctgacgacacggccgtgtattactgtgcgagagacattgactccggtgactaccgcgccgctgatgttttccagatctggggccaagggacaatggtcaccgtctcttcagcgtcgaccaagggcccatcggtcttccccctggcaccctcctccaagagcacctctgggggcacagcggccctgggctgcctggtcaaggactacttccccgaacc

SEQ ID NO: 489 - protein, 124 aa, Homo sapiens
QVQLVQSGSEVRKPGASVKVSCKASGFTFTDCFIHWVRQAPGQGLEWMGRINPSRGTTKYAEKFRGRVSMTRDMAINTAYMDMSRLQSDDTAVYYCARDIDSGDYRAADVFQIWGQGTMVTVSS

SEQ ID NO: 490 - protein, 11 aa, Homo sapiens
WGQGTMVTVSS

SEQ ID NO: 491 - protein, 90 aa, Homo sapiens
DIQMTQSPSSLSASLGDRVTITCQASQDFSNYLNWYQQKPGKAPKLLIYDASNLETGVPSRFSGSGSGTEYTLTISSLQPEDSATYYCQQ

SEQ ID NO: 492 - protein, 26 aa, Homo sapiens
DIQMTQSPSSLSASLGDRVTITCQAS

SEQ ID NO: 493 - protein, 6 aa, Homo sapiens
QDFSNY

SEQ ID NO: 494 - protein, 17 aa, Homo sapiens
LNWYQQKPGKAPKLLIY

SEQ ID NO: 495 - skipped

SEQ ID NO: 496 - protein, 36 aa, Homo sapiens
NLETGVPSRFSGSGSGTEYTLTISSLQPEDSATYYC

SEQ ID NO: 497 - protein, 5 aa, Homo sapiens
QQLTT

SEQ ID NO: 498 - DNA, 484 bp, Homo sapiens
gacatccagatgacccagtctccatcctccctgtctgcgtctctaggagacagagtcaccatcacttgccaggcgagtcaggactttagcaactatttaaattggtatcagcagaaaccagggaaagcccctaagctcctgatctacgatgcatccaatttggaaacaggggtcccatcaagattcagtggaagtggatctgggacagaatatactttaaccatcagcagcctgcagcctgaagattctgcaacatattactgtcaacagttgactacgttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagc

SEQ ID NO: 499 - protein, 103 aa, Homo sapiens
DIQMTQSPSSLSASLGDRVTITCQASQDFSNYLNWYQQKPGKAPKLLIYDASNLETGVPSRFSGSGSGTEYTLTISSLQPEDSATYYCQQLTTFGPGTKVDIK

SEQ ID NO: 500 - protein, 10 aa, Homo sapiens
FGPGTKVDIK

SEQ ID NO: 501 - protein, 98 aa, Homo sapiens
QVQLVQSGAEVKKPGASVKVSCKASGFRFSDLYIHWVRQAPGQGLEWMGRINPTRGTTKYAEKFLGRVSMTRDTAISTAYLDVTRLQSDDTALYYCAR

SEQ ID NO: 502 - protein, 25 aa, Homo sapiens [sequence omitted]

SEQ ID NO: 503 - protein, 8 aa, Homo sapiens
GFRFSDLY

SEQ ID NO: 504 - protein, 17 aa, Homo sapiens
IHWVRQAPGQGLEWMGR

SEQ ID NO: 505 - protein, 8 aa, Homo sapiens
INPTRGTT

SEQ ID NO: 506 - protein, 38 aa, Homo sapiens
KYAEKFLGRVSMTRDTAISTAYLDVTRLQSDDTALYYC

SEQ ID NO: 507 - protein, 17 aa, Homo sapiens
ARDIDSGDYRAADVFQI

SEQ ID NO: 508 - DNA, 479 bp, Homo sapiens
caggtgcagctggtgcagtctggggctgaggtgaagaagcctggggcctcagtgaaggtctcctgcaaggcttctggattcaggttcagcgacttgtatatacactgggtgcgacaggcccctggacaggggcttgagtggatgggtcggatcaatcctaccagaggaaccacaaaatatgcagagaaatttctgggccgggtctcgatgaccagggacacggccatcagcacagcctatttggacgtgaccaggctgcaatctgacgacacggccctttattactgtgcgcgagacattgactccggtgactaccgcgccgctgatgtttttcagatctggggccaagggacaatggtcaccgtctcttcagcgtcgaccaagggcccatcggtcttccccctggcaccctcctccaagagcacctctgggggcacagcggccctgggctgcctggtcaaggactacttccccgaacc

SEQ ID NO: 509 - protein, 124 aa, Homo sapiens
QVQLVQSGAEVKKPGASVKVSCKASGFRFSDLYIHWVRQAPGQGLEWMGRINPTRGTTKYAEKFLGRVSMTRDTAISTAYLDVTRLQSDDTALYYCARDIDSGDYRAADVFQIWGQGTMVTVSS

SEQ ID NO: 510 - protein, 11 aa, Homo sapiens
WGQGTMVTVSS

SEQ ID NO: 511 - protein, 90 aa, Homo sapiens
DIQMTQSPSSLSASVGDRVTITCQASQDFSNYLNWYQQKPGKAPKLLIYDASNLETGVPSRFSGSGSGTEYTLTISSLQPEDFATYYCQQ

SEQ ID NO: 512 - protein, 26 aa, Homo sapiens
DIQMTQSPSSLSASVGDRVTITCQAS

SEQ ID NO: 513 - protein, 6 aa, Homo sapiens
QDFSNY

SEQ ID NO: 514 - protein, 17 aa, Homo sapiens
LNWYQQKPGKAPKLLIY

SEQ ID NO: 515 - skipped

SEQ ID NO: 516 - protein, 36 aa, Homo sapiens
NLETGVPSRFSGSGSGTEYTLTISSLQPEDFATYYC

SEQ ID NO: 517 - protein, 5 aa, Homo sapiens
QQLAT

SEQ ID NO: 518 - DNA, 484 bp, Homo sapiens
gacatccagatgacccagtctccatcctccctgtctgcgtctgtaggagacagagtcaccatcacttgccaggcgagtcaggactttagcaactatttaaattggtatcagcagaaaccagggaaagcccctaagctcctgatctacgatgcatccaatttggaaacaggggtcccatcaagattcagtggaagtggatctgggacagaatatactttaaccatcagcagcctgcagcctgaagattttgcaacatattactgtcaacagttggctactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagc

SEQ ID NO: 519 - protein, 103 aa, Homo sapiens
DIQMTQSPSSLSASVGDRVTITCQASQDFSNYLNWYQQKPGKAPKLLIYDASNLETGVPSRFSGSGSGTEYTLTISSLQPEDFATYYCQQLATFGPGTKVDIK

SEQ ID NO: 520 - protein, 10 aa, Homo sapiens
FGPGTKVDIK

SEQ ID NO: 521 - protein, 98 aa, Homo sapiens
QVQLVQSGSEVRKPGASVKVSCKASGFTFTDCFIHWVRQAPGQGPEWMGRINPSRGTTKYAEKFRGRVSMTRDTAINTAYMDVSRLQSDDTAVYYCAR

SEQ ID NO: 522 - protein, 25 aa, Homo sapiens
QVQLVQSGSEVRKPGASVKVSCKAS

SEQ ID NO: 523 - protein, 8 aa, Homo sapiens
GFTFTDCF

SEQ ID NO: 524 - protein, 17 aa, Homo sapiens
IHWVRQAPGQGPEWMGR

SEQ ID NO: 525 - protein, 8 aa, Homo sapiens
INPSRGTT

SEQ ID NO: 526 - protein, 38 aa, Homo sapiens
KYAEKFRGRVSMTRDTAINTAYMDVSRLQSDDTAVYYC

SEQ ID NO: 527 - protein, 17 aa, Homo sapiens
ARDIDSGDYRAADVFQI

SEQ ID NO: 528 - DNA, 559 bp, Homo sapiens
caggtgcagctggtgcagtctgggtctgaggtgaggaagcctggggcctcagtgaaggtctcctgcaaggcttctggattcacattcaccgactgctttatacactgggtgcgacaggcccctggacaggggcctgagtggatgggtcggatcaatcctagtagaggaaccacaaaatatgcagagaaatttcggggccgggtctcgatgacccgggacacggccatcaacacagcctacatggacgtgagcaggctgcaatctgacgacacggccgtgtattactgtgcgagagacattgactccggtgactaccgcgccgctgatgtttttcagatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactct

SEQ ID NO: 529 - protein, 124 aa, Homo sapiens
QVQLVQSGSEVRKPGASVKVSCKASGFTFTDCFIHWVRQAPGQGPEWMGRINPSRGTTKYAEKFRGRVSMTRDTAINTAYMDVSRLQSDDTAVYYCARDIDSGDYRAADVFQIWGQGTMVTVSS

SEQ ID NO: 530 - protein, 11 aa, Homo sapiens
WGQGTMVTVSS

SEQ ID NO: 531 - protein, 90 aa, Homo sapiens; identical to SEQ ID NO: 491

SEQ ID NO: 532 - protein, 26 aa, Homo sapiens
DIQMTQSPSSLSASLGDRVTITCQAS

SEQ ID NO: 533 - protein, 6 aa, Homo sapiens
QDFSNY

SEQ ID NO: 534 - protein, 17 aa, Homo sapiens
LNWYQQKPGKAPKLLIY

SEQ ID NO: 535 - skipped

SEQ ID NO: 536 - protein, 36 aa, Homo sapiens; identical to SEQ ID NO: 496

SEQ ID NO: 537 - protein, 5 aa, Homo sapiens
QQLTT

SEQ ID NO: 538 - DNA, 484 bp, Homo sapiens; identical to SEQ ID NO: 498

SEQ ID NO: 539 - protein, 103 aa, Homo sapiens; identical to SEQ ID NO: 499

SEQ ID NO: 540 - protein, 10 aa, Homo sapiens
FGPGTKVDIK

SEQ ID NO: 541 - protein, 98 aa, Homo sapiens
EVQLVESGGGLVQPGGSLRLSCAASGFTFSSYSMSWVRQAPGKGLEWVANMNKEGGEKNHVDYVKGRFTISRDNAKSTLYLQMNSLRAEDTAVYYCAR

SEQ ID NO: 542 - protein, 25 aa, Homo sapiens [sequence omitted]

SEQ ID NO: 543 - protein, 8 aa, Homo sapiens
GFTFSSYS

SEQ ID NO: 544 - protein, 17 aa, Homo sapiens
MSWVRQAPGKGLEWVAN

SEQ ID NO: 545 - protein, 8 aa, Homo sapiens
MNKEGGEK

SEQ ID NO: 546 - protein, 38 aa, Homo sapiens
NHVDYVKGRFTISRDNAKSTLYLQMNSLRAEDTAVYYC

SEQ ID NO: 547 - protein, 22 aa, Homo sapiens
ARVSREEWATVDDPHDYYYMDV

SEQ ID NO: 548 - DNA, 478 bp, Homo sapiens
gaggtgcagctggtggagtctgggggaggcttggtccagcctggggggtccctgagactctcctgcgcagcctctggattcacctttagtagttattcgatgagctgggtccgccaggctccagggaaggggctggagtgggtggccaatatgaacaaagagggaggtgaaaaaaaccatgtggactatgtgaagggccgattcactatctccagagacaacgccaagagtacactgtatctgcaaatgaatagtctgagagccgaggacacggcggtgtattactgtgcgagagtctccagggaagagtgggcgacagttgacgaccctcacgactactattacatggacgtctggggccaagggaccacggtcaccgtctcctcagcgtcgaccaagggcccatcggtcttccccctggcaccctcctccaagagcacctctgggggcacagcggccctgggctgcctggtcaagg

SEQ ID NO: 549 - protein, 129 aa, Homo sapiens
EVQLVESGGGLVQPGGSLRLSCAASGFTFSSYSMSWVRQAPGKGLEWVANMNKEGGEKNHVDYVKGRFTISRDNAKSTLYLQMNSLRAEDTAVYYCARVSREEWATVDDPHDYYYMDVWGQGTTVTVSS

SEQ ID NO: 550 - protein, 11 aa, Homo sapiens
WGQGTTVTVSS

SEQ ID NO: 551 - protein, 94 aa, Homo sapiens
DIQMTQSPSSLSASVGGGVTITCRASQRISNYLNWYHQQPGKAPKLLIYNAYTLQSGVPSRFSGTGSGTDFTLTISSLQPEDFGTFYCQQSYNS

SEQ ID NO: 552 - protein, 26 aa, Homo sapiens
DIQMTQSPSSLSASVGGGVTITCRAS

SEQ ID NO: 553 - protein, 6 aa, Homo sapiens
QRISNY

SEQ ID NO: 554 - protein, 17 aa, Homo sapiens
LNWYHQQPGKAPKLLIY

SEQ ID NO: 555 - skipped

SEQ ID NO: 556 - protein, 36 aa, Homo sapiens
TLQSGVPSRFSGTGSGTDFTLTISSLQPEDFGTFYC

SEQ ID NO: 557 - protein, 9 aa, Homo sapiens
QQSYNSLFT

SEQ ID NO: 558 - DNA, 483 bp, Homo sapiens
gacatccagatgacccagtctccatcctccctgtctgcatctgtgggaggcggagtcaccatcacttgccgggcaagtcagaggattagcaactacttaaattggtatcaccaacaaccaggcaaagcccctaaactcctgatctataacgcatacactttacagagtggggtcccatcaaggttcagtggcactggatctgggacagatttcactctcaccatcagcagtctgcaacctgaagattttggtactttctactgtcaacagagttacaatagcctgttcactttcggcggggggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggag

SEQ ID NO: 559 - protein, 107 aa, Homo sapiens
DIQMTQSPSSLSASVGGGVTITCRASQRISNYLNWYHQQPGKAPKLLIYNAYTLQSGVPSRFSGTGSGTDFTLTISSLQPEDFGTFYCQQSYNSLFTFGGGTKVEIK

SEQ ID NO: 560 - protein, 10 aa, Homo sapiens
FGGGTKVEIK

SEQ ID NO: 561 - protein, 98 aa, Homo sapiens
QVQLVQSGAEVKKPGASVKVSCKASGYTFTSYAISWVRQAPGQGLEWMGWISTYNGNSYYAQKLQDRVTMTTDTSTNTAYMELRSLRSDDTAVYFCAR

SEQ ID NO: 562 - protein, 25 aa, Homo sapiens [sequence omitted]

SEQ ID NO: 563 - protein, 8 aa, Homo sapiens
GYTFTSYA

SEQ ID NO: 564 - protein, 17 aa, Homo sapiens
ISWVRQAPGQGLEWMGW

SEQ ID NO: 565 - protein, 8 aa, Homo sapiens
ISTYNGNS

SEQ ID NO: 566 - protein, 38 aa, Homo sapiens
YYAQKLQDRVTMTTDTSTNTAYMELRSLRSDDTAVYFC

SEQ ID NO: 567 - protein, 24 aa, Homo sapiens
AREGYDHLWGTYRFEAIDYYYTDV

SEQ ID NO: 568 - DNA, 480 bp, Homo sapiens
caggtgcagctggtgcagtctggagctgaggtgaagaagcctggggcctcagtgaaggtctcctgcaaggcttctgggtacacctttaccagttatgctatcagctgggtgcgacaggcccctggacaagggcttgagtggatgggatggatcagcacttacaatggtaactcatactatgcacagaaactccaagacagagtcaccatgaccacagacacatccacgaacacagcctacatggagctgaggagcctgagatctgacgacacggccgtctatttttgtgcgagagagggatatgatcacctttgggggacttatcgctttgaggcgatagactactactacacggacgtctggggccaaggaaccacggtcaccgtctcctcagcgtcgaccaagggcccatcggtcttccccctggcaccctcctccaagagcacctctgggggcacagcggccctgggctgcctggtc

SEQ ID NO: 569 - protein, 131 aa, Homo sapiens
QVQLVQSGAEVKKPGASVKVSCKASGYTFTSYAISWVRQAPGQGLEWMGWISTYNGNSYYAQKLQDRVTMTTDTSTNTAYMELRSLRSDDTAVYFCAREGYDHLWGTYRFEAIDYYYTDVWGQGTTVTVSS

SEQ ID NO: 570 - protein, 11 aa, Homo sapiens
WGQGTTVTVSS

SEQ ID NO: 571 - protein, 95 aa, Homo sapiens
  MOD_RES (32)..(32): Any amino acid
EIVLTQSPGTLSLSPGERATLSCRASQSLSSXYLAWYQQKPGQAPRLLIYGASSRATGIPDRFSGSGSGTDFTLTITRLEPEDSAVYYCHQYGSS

SEQ ID NO: 572 - protein, 26 aa, Homo sapiens [sequence omitted]

SEQ ID NO: 573 - protein, 7 aa, Homo sapiens
  MOD_RES (6)..(6): Any amino acid
QSLSSXY

SEQ ID NO: 574 - protein, 17 aa, Homo sapiens
LAWYQQKPGQAPRLLIY

SEQ ID NO: 575 - skipped

SEQ ID NO: 576 - protein, 36 aa, Homo sapiens
SRATGIPDRFSGSGSGTDFTLTITRLEPEDSAVYYC

SEQ ID NO: 577 - protein, 9 aa, Homo sapiens
HQYGSSTGT

SEQ ID NO: 578 - DNA, 563 bp, Homo sapiens
  modified_base (94)..(96): a, c, t, g, unknown or other
  misc_feature (94)..(96): a, c, t, g, unknown or other
gaaattgtgttgacgcagtctccaggcaccctgtctttgtctccaggggaaagagccaccctctcctgcagggccagtcagagtcttagcagcnnntacttagcctggtaccagcagaaacctggccaggctcccaggctcctcatatatggtgcatccagcagggccaccggcatcccagacaggttcagtggcagtgggtctgggacagacttcactctcaccatcaccagactggagcctgaagattctgcagtgtattattgtcaccagtatggtagctcaacgggaacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacga

SEQ ID NO: 579 - protein, 108 aa, Homo sapiens
  MOD_RES (32)..(32): Any amino acid
EIVLTQSPGTLSLSPGERATLSCRASQSLSSXYLAWYQQKPGQAPRLLIYGASSRATGIPDRFSGSGSGTDFTLTITRLEPEDSAVYYCHQYGSSTGTFGQGTKVEIK

SEQ ID NO: 580 - protein, 10 aa, Homo sapiens
FGQGTKVEIK

SEQ ID NO: 581 - protein, 98 aa, Homo sapiens
QVQLVQSGAEVKRPGASVNVSCRASGFSFSDTYIHWVRQAPGQGLEWMGRLNPKRGTTKYAGHFQGRLTLTRDASINTAYMELSRLGTGDTAVYYCAR

SEQ ID NO: 582 - protein, 25 aa, Homo sapiens
QVQLVQSGAEVKRPGASVNVSCRAS

SEQ ID NO: 583 - protein, 8 aa, Homo sapiens
GFSFSDTY

SEQ ID NO: 584 - protein, 17 aa, Homo sapiens
IHWVRQAPGQGLEWMGR

SEQ ID NO: 585 - protein, 8 aa, Homo sapiens
LNPKRGTT

SEQ ID NO: 586 - protein, 38 aa, Homo sapiens
KYAGHFQGRLTLTRDASINTAYMELSRLGTGDTAVYYC

SEQ ID NO: 587 - protein, 17 aa, Homo sapiens
ARDIDFGDYRAADVFHI

SEQ ID NO: 588 - DNA, 558 bp, Homo sapiens
caggtgcagctggtgcagtctggggctgaggtgaagaggcctggggcctcagtgaacgtctcctgcagggcttctggattcagtttcagcgacacctatatacactgggtgcgacaggctcctgggcaggggctagagtggatgggacgactcaatcctaagagaggaaccacaaaatatgcagggcactttcagggcaggctcacgttgaccagggacgcgtccatcaacacagcctacatggagttgagcaggctggggactggcgacacggccgtctattactgcgcgcgagacattgacttcggtgactaccgcgccgctgatgtttttcatatatggggccaggggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactc

SEQ ID NO: 589 - protein, 124 aa, Homo sapiens
QVQLVQSGAEVKRPGASVNVSCRASGFSFSDTYIHWVRQAPGQGLEWMGRLNPKRGTTKYAGHFQGRLTLTRDASINTAYMELSRLGTGDTAVYYCARDIDFGDYRAADVFHIWGQGTMVTVSS

SEQ ID NO: 590 - protein, 11 aa, Homo sapiens
WGQGTMVTVSS

SEQ ID NO: 591 - protein, 90 aa, Homo sapiens
DIQMTQSPSSLSASVGDRVTITCQASQDFSNFLNWYQQRPGKAPKLLIYDASNLETGVPSRFSGRKSGAHYTLTISSLQAEDIATYYCQQ

SEQ ID NO: 592 - protein, 26 aa, Homo sapiens
DIQMTQSPSSLSASVGDRVTITCQAS

SEQ ID NO: 593 - protein, 6 aa, Homo sapiens
QDFSNF

SEQ ID NO: 594 - protein, 17 aa, Homo sapiens
LNWYQQRPGKAPKLLIY

SEQ ID NO: 595 - skipped

SEQ ID NO: 596 - protein, 36 aa, Homo sapiens
NLETGVPSRFSGRKSGAHYTLTISSLQAEDIATYYC

SEQ ID NO: 597 - protein, 5 aa, Homo sapiens
QQLDT

SEQ ID NO: 598 - DNA, 565 bp, Homo sapiens
gacatccagatgacccagtctccatcctccctgtctgcatctgtaggagacagagtcaccatcacttgccaggcgagtcaggactttagtaattttcttaattggtatcaacagagacctgggaaagcccctaaactcctgatctacgatgcatccaatttggagacaggggtcccatcaaggttcagtggaagaaaatctggggcacactatactctcaccatcagcagcctgcaggctgaagatattgcaacatattattgtcaacagttggatactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacg

SEQ ID NO: 599 - protein, 103 aa, Homo sapiens
DIQMTQSPSSLSASVGDRVTITCQASQDFSNFLNWYQQRPGKAPKLLIYDASNLETGVPSRFSGRKSGAHYTLTISSLQAEDIATYYCQQLDTFGPGTKVDIK

SEQ ID NO: 600 - protein, 10 aa, Homo sapiens
FGPGTKVDIK

SEQ ID NO: 601 - protein, 98 aa, Homo sapiens
QVQLVQSGAEVKKPGTSVKVSCKASGYIFSGSYIQWVRQAPGQGLEWMGRINPKTGGTNYPQKFQGRVTMTRDMSISTAYMELSRLISDDTAVYYCAR

SEQ ID NO: 602 - protein, 25 aa, Homo sapiens
QVQLVQSGAEVKKPGTSVKVSCKAS

SEQ ID NO: 603 - protein, 8 aa, Homo sapiens
GYIFSGSY

SEQ ID NO: 604 - protein, 17 aa, Homo sapiens
IQWVRQAPGQGLEWMGR

SEQ ID NO: 605 - protein, 8 aa, Homo sapiens
INPKTGGT

SEQ ID NO: 606 - protein, 38 aa, Homo sapiens
NYPQKFQGRVTMTRDMSISTAYMELSRLISDDTAVYYC

SEQ ID NO: 607 - protein, 16 aa, Homo sapiens
ARDFDYGDYRGSAFDI

SEQ ID NO: 608 - DNA, 561 bp, Homo sapiens
caggtgcagctggtgcagtctggggctgaggtaaagaagcctgggacctcagtgaaagtctcctgcaaggcttctggatacatcttctccggctcctatattcaatgggtacgacaggcccctggacaagggcttgagtggatgggaaggatcaaccctaagactggtggcacaaattatccacagaagtttcagggcagggtcaccatgaccagggacatgtccatcagcacagcctatatggagctgagtaggctgatctctgacgacacggccgtgtattactgtgcgagagacttcgattacggtgactaccgcggctctgcttttgatatctggggccaaggggcaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactcc

SEQ ID NO: 609 - protein, 123 aa, Homo sapiens
QVQLVQSGAEVKKPGTSVKVSCKASGYIFSGSYIQWVRQAPGQGLEWMGRINPKTGGTNYPQKFQGRVTMTRDMSISTAYMELSRLISDDTAVYYCARDFDYGDYRGSAFDIWGQGAMVTVSS

SEQ ID NO: 610 - protein, 11 aa, Homo sapiens
WGQGAMVTVSS

SEQ ID NO: 611 - protein, 90 aa, Homo sapiens
DIQMTQSPSSLSASVGDRVTITCQTSQDFSNYLNWYQQKPGKAPKLLIHDTSKLETGVPSRFSGGGAGTYFTLTINGLQPEDIATYWCQQ

SEQ ID NO: 612 - protein, 26 aa, Homo sapiens
DIQMTQSPSSLSASVGDRVTITCQTS

SEQ ID NO: 613 - protein, 6 aa, Homo sapiens
QDFSNY

SEQ ID NO: 614 - protein, 17 aa, Homo sapiens
LNWYQQKPGKAPKLLIH

SEQ ID NO: 615 - skipped

SEQ ID NO: 616 - protein, 36 aa, Homo sapiens
KLETGVPSRFSGGGAGTYFTLTINGLQPEDIATYWC

SEQ ID NO: 617 - protein, 5 aa, Homo sapiens
QQLNT

SEQ ID NO: 618 - DNA, 564 bp, Homo sapiens
gacatccagatgacccagtctccatcctccctgtctgcatctgttggtgacagagtcaccatcacttgccagacgagtcaggactttagcaattatttaaattggtatcagcagaaaccaggaaaagcccctaaactcctgatccacgatacatccaagttggaaacaggggtcccatcaagattcagtggaggtggggccgggacatattttactctcaccatcaacggcctgcagcctgaagacattgcaacatattggtgtcaacagttgaataccttcggtcctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctac

SEQ ID NO: 619 - protein, 103 aa, Homo sapiens
DIQMTQSPSSLSASVGDRVTITCQTSQDFSNYLNWYQQKPGKAPKLLIHDTSKLETGVPSRFSGGGAGTYFTLTINGLQPEDIATYWCQQLNTFGPGTKVDIK

SEQ ID NO: 620 - protein, 10 aa, Homo sapiens
FGPGTKVDIK

SEQ ID NO: 621 - protein, 98 aa, Homo sapiens
EVQLLESGGDLVQPGGSLRLSCAASGFIFRSYAMSWVRQAPGKGLEWVSMISGSSEDTHYADSVKGRFTISRDNSKNTVYLRMNNLRAEDTAFYYCAR

SEQ ID NO: 622 - protein, 25 aa, Homo sapiens
EVQLLESGGDLVQPGGSLRLSCAAS

SEQ ID NO: 623 - protein, 8 aa, Homo sapiens
GFIFRSYA

SEQ ID NO: 624 - protein, 17 aa, Homo sapiens
MSWVRQAPGKGLEWVSM

SEQ ID NO: 625 - protein, 8 aa, Homo sapiens
ISGSSEDT

SEQ ID NO: 626 - protein, 38 aa, Homo sapiens
HYADSVKGRFTISRDNSKNTVYLRMNNLRAEDTAFYYC

SEQ ID NO: 627 - protein, 19 aa, Homo sapiens
AREEFTDTEMTINQGDFAY

SEQ ID NO: 628 - DNA, 560 bp, Homo sapiens
gaggtgcagctgttggagtctgggggagacttggtacagccgggggggtccctgagactctcctgtgcagcctctggattcatctttagaagttatgccatgagctgggtccgccaggctccagggaagggtctggagtgggtctcaatgattagtggtagcagtgaagatacacactacgcagactccgtgaagggccggttcaccatctccagagacaattccaagaacaccgtttatctgcgcatgaataatctgagagccgaggacacggccttttattactgtgcgagagaggagtttaccgacacagagatgactataaaccaaggggactttgcctactggggccacggcaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcagg

SEQ ID NO: 629 - protein, 126 aa, Homo sapiens
EVQLLESGGDLVQPGGSLRLSCAASGFIFRSYAMSWVRQAPGKGLEWVSMISGSSEDTHYADSVKGRFTISRDNSKNTVYLRMNNLRAEDTAFYYCAREEFTDTEMTINQGDFAYWGHGTLVTVSS

SEQ ID NO: 630 - protein, 11 aa, Homo sapiens
WGHGTLVTVSS

SEQ ID NO: 631 - protein, 94 aa, Homo sapiens
DIQMTQSPSSLSASVGDTVTITCRASQSISVYLNWYQQKPGKAPKLLIYGASILQSGVPSRFSGIGSGTDFTLTISSLQPEDFATYYCQRSFIT

SEQ ID NO: 632 - protein, 26 aa, Homo sapiens
DIQMTQSPSSLSASVGDTVTITCRAS

SEQ ID NO: 633 - protein, 6 aa, Homo sapiens
QSISVY

SEQ ID NO: 634 - protein, 17 aa, Homo sapiens
LNWYQQKPGKAPKLLIY

SEQ ID NO: 635 - skipped

SEQ ID NO: 636 - protein, 36 aa, Homo sapiens
ILQSGVPSRFSGIGSGTDFTLTISSLQPEDFATYYC

SEQ ID NO: 637 - protein, 9 aa, Homo sapiens
QRSFITPFT

SEQ ID NO: 638 - DNA, 566 bp, Homo sapiens
gacatccagatgacccagtctccatcctccctgtctgcatctgtaggagacacagtcaccatcacttgccgggcaagtcagagcattagtgtctatttaaattggtatcaacaaaaaccagggaaagcccctaagctcctgatctatggtgcatccattttgcaaagtggtgtcccgtcaaggttcagtggcattggatccgggacagatttcactctcaccatcagcagtctgcaacctgaagatttcgcaacttactactgtcaacggagtttcatcactccattcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaaca

SEQ ID NO: 639 - protein, 107 aa, Homo sapiens
DIQMTQSPSSLSASVGDTVTITCRASQSISVYLNWYQQKPGKAPKLLIYGASILQSGVPSRFSGIGSGTDFTLTISSLQPEDFATYYCQRSFITPFTFGPGTKVDIK

SEQ ID NO: 640 - protein, 10 aa, Homo sapiens
FGPGTKVDIK

SEQ ID NO: 641 - protein, 98 aa, Homo sapiens
QVQLVQSGAEVKKPGTSVKVSCKASGYVFSDSYIQWVRQAPGQGLEWMGRINPKTGGTNFAQKFQGRVTMTRDMSISTAYMDLSRLISDDTAVYYCAR

SEQ ID NO: 642 - protein, 25 aa, Homo sapiens
QVQLVQSGAEVKKPGTSVKVSCKAS

SEQ ID NO: 643 - protein, 8 aa, Homo sapiens
GYVFSDSY

SEQ ID NO: 644 - protein, 17 aa, Homo sapiens
IQWVRQAPGQGLEWMGR

SEQ ID NO: 645 - protein, 8 aa, Homo sapiens
INPKTGGT

SEQ ID NO: 646 - protein, 38 aa, Homo sapiens
NFAQKFQGRVTMTRDMSISTAYMDLSRLISDDTAVYYC

SEQ ID NO: 647 - protein, 16 aa, Homo sapiens
ARDFDYGDYRGSAFDI

SEQ ID NO: 648 - DNA, 559 bp, Homo sapiens
caggtgcagctggtgcagtctggggctgaggtaaagaagcctgggacctcagtgaaagtctcctgcaaggcttctggatacgtcttctccgactcctatattcaatgggtacgacaggcccctggacaagggcttgagtggatgggaaggatcaaccctaagactggtggcacaaattttgcacagaagtttcagggcagggtcaccatgaccagggacatgtccatcagcacagcctatatggacctgagtaggctgatctctgacgacacggccgtatattactgtgcgagagacttcgattacggtgactaccgcggctctgcttttgatatctggggccaaggggcaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctact

SEQ ID NO: 649 - protein, 123 aa, Homo sapiens
QVQLVQSGAEVKKPGTSVKVSCKASGYVFSDSYIQWVRQAPGQGLEWMGRINPKTGGTNFAQKFQGRVTMTRDMSISTAYMDLSRLISDDTAVYYCARDFDYGDYRGSAFDIWGQGAMVTVSS

SEQ ID NO: 650 - protein, 11 aa, Homo sapiens
WGQGAMVTVSS

SEQ ID NO: 651 - protein, 90 aa, Homo sapiens; identical to SEQ ID NO: 611

SEQ ID NO: 652 - protein, 26 aa, Homo sapiens
DIQMTQSPSSLSASVGDRVTITCQTS

SEQ ID NO: 653 - protein, 6 aa, Homo sapiens
QDFSNY

SEQ ID NO: 654 - protein, 17 aa, Homo sapiens
LNWYQQKPGKAPKLLIH

SEQ ID NO: 655 - skipped

SEQ ID NO: 656 - protein, 36 aa, Homo sapiens; identical to SEQ ID NO: 616

SEQ ID NO: 657 - protein, 5 aa, Homo sapiens
QQLNT

SEQ ID NO: 658 - DNA, 564 bp, Homo sapiens
gacatccagatgacccagtctccatcctccctgtctgcatctgttggtgacagagtcaccatcacttgccagacgagtcaggactttagcaattatttaaattggtatcagcagaaaccaggaaaagcccctaaactcctgatccacgatacatccaagttggaaacaggggtcccatcaagattcagtggaggtggggccgggacatattttactctcaccatcaacggcctgcagcctgaagacattgcaacatattggtgtcaacagttgaataccttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctac

SEQ ID NO: 659 - protein, 103 aa, Homo sapiens; identical to SEQ ID NO: 619

SEQ ID NO: 660 - protein, 10 aa, Homo sapiens
FGPGTKVDIK

SEQ ID NO: 661 - protein, 98 aa, Homo sapiens
QVQLVESGGGLVQPGRSLRLSCVASGFNFFNYPMHWVRQAPGKGLEWVAVITYDGSDKYYADSVKGRFTISRDNSKDTLYLEMNNLRSEDTALYYCAR

SEQ ID NO: 662 - protein, 25 aa, Homo sapiens
QVQLVESGGGLVQPGRSLRLSCVAS

SEQ ID NO: 663 - protein, 8 aa, Homo sapiens
GFNFFNYP

SEQ ID NO: 664 - protein, 17 aa, Homo sapiens
MHWVRQAPGKGLEWVAV

SEQ ID NO: 665 - protein, 8 aa, Homo sapiens
ITYDGSDK

SEQ ID NO: 666 - protein, 38 aa, Homo sapiens
YYADSVKGRFTISRDNSKDTLYLEMNNLRSEDTALYYC

SEQ ID NO: 667 - protein, 14 aa, Homo sapiens
ARDQELVVLYYFDF

SEQ ID NO: 668 - DNA, 561 bp, Homo sapiens
caggtgcagctggtggagtctgggggaggcttggtccagcctgggaggtccctgagactctcctgtgtagcctctggattcaacttctttaattatcccatgcactgggtccgccaggctccaggcaaggggcttgagtgggtggctgtcataacatatgatggaagtgataaatactatgcagactccgtgaagggccgattcaccatttccagagacaactccaaggacacactgtatttggagatgaacaacctgagatcggaggacacggctctttattattgcgcgagagatcaggaactggtggtcctttattattttgacttctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagc

SEQ ID NO: 669 - protein, 121 aa, Homo sapiens
QVQLVESGGGLVQPGRSLRLSCVASGFNFFNYPMHWVRQAPGKGLEWVAVITYDGSDKYYADSVKGRFTISRDNSKDTLYLEMNNLRSEDTALYYCARDQELVVLYYFDFWGQGTLVTVSS

SEQ ID NO: 670 - protein, 11 aa, Homo sapiens
WGQGTLVTVSS

SEQ ID NO: 671 - protein, 96 aa, Homo sapiens
SYELTQPPSVSVAPGQTARLTCGGNNIGSKNVHWYQQRPGQAPVLVVYDTSDRPSGIPERFSGSSSENTATLTISGVQGGDEADYSCQVYDNSVDH

SEQ ID NO: 672 - protein, 25 aa, Homo sapiens
SYELTQPPSVSVAPGQTARLTCGGN

SEQ ID NO: 673 - protein, 6 aa, Homo sapiens
NIGSKN

SEQ ID NO: 674 - protein, 17 aa, Homo sapiens
VHWYQQRPGQAPVLVVY

SEQ ID NO: 675 - skipped

SEQ ID NO: 676 - protein, 36 aa, Homo sapiens
DRPSGIPERFSGSSSENTATLTISGVQGGDEADYSC

SEQ ID NO: 677 - protein, 11 aa, Homo sapiens
QVYDNSVDHAV

SEQ ID NO: 678 - DNA, 561 bp, Homo sapiens
tcctatgagctgacacagccaccctcggtgtcagtggccccaggccagacggccaggttgacctgtgggggaaacaacattggaagtaaaaatgtgcactggtatcagcagaggccaggccaggcccctgttctggtcgtctatgatactagcgaccggccctcagggatccctgagcgattctctggctccagctctgagaacacggccaccctgaccatcagcggggtccaaggcggagatgaggccgactactcctgtcaggtttatgataatagtgttgatcatgcggtcttcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtgg

SEQ ID NO: 679 - protein, 108 aa, Homo sapiens
SYELTQPPSVSVAPGQTARLTCGGNNIGSKNVHWYQQRPGQAPVLVVYDTSDRPSGIPERFSGSSSENTATLTISGVQGGDEADYSCQVYDNSVDHAVFGGGTKLTVL

SEQ ID NO: 680 - protein, 10 aa, Homo sapiens
FGGGTKLTVL

SEQ ID NO: 681 - protein, 98 aa, Homo sapiens
EVQLLESGGGLVQPGGSLRLSCAASGFPFSSFAMSWVRQSPGKGLQWVSSISGGGDATSYADSVKGRFTISRDNSKNTLYLQMNSLRAEDTAVYYCAK

SEQ ID NO: 682 - protein, 25 aa, Homo sapiens
EVQLLESGGGLVQPGGSLRLSCAAS

SEQ ID NO: 683 - protein, 8 aa, Homo sapiens
GFPFSSFA

SEQ ID NO: 684 - protein, 17 aa, Homo sapiens
MSWVRQSPGKGLQWVSS

SEQ ID NO: 685 - protein, 8 aa, Homo sapiens
ISGGGDAT

SEQ ID NO: 686 - protein, 38 aa, Homo sapiens
SYADSVKGRFTISRDNSKNTLYLQMNSLRAEDTAVYYC

SEQ ID NO: 687 - protein, 15 aa, Homo sapiens
AKEPYRDYLGNWPDP

SEQ ID NO: 688 - DNA, 480 bp, Homo sapiens
gaggtgcagctgttggagtctgggggaggcttggtacagcctggggggtccctgagactctcctgtgcggcctctggattcccctttagcagctttgccatgagctgggtccgccagtctccagggaaggggctacaatgggtctcgtctattagtggaggtggagatgccacatcctacgcagactccgtgaagggccgattcaccatctccagggacaattccaagaacacgctatatctgcagatgaacagcctgagagccgaggacacggccgtgtattactgtgcgaaagagccataccgtgactacctggggaactggcccgacccctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacg

SEQ ID NO: 689 - protein, 122 aa, Homo sapiens
EVQLLESGGGLVQPGGSLRLSCAASGFPFSSFAMSWVRQSPGKGLQWVSSISGGGDATSYADSVKGRFTISRDNSKNTLYLQMNSLRAEDTAVYYCAKEPYRDYLGNWPDPWGQGTLVTVSS

SEQ ID NO: 690 - protein, 11 aa, Homo sapiens
WGQGTLVTVSS

SEQ ID NO: 691 - protein, 101 aa, Homo sapiens
DIVMTQSPDSLAVSLGERATVNCRASQSVLYNSNNKNYLTWYQQKPGQSPKLLIYWASTRESGVPDRFSGSGSGTDFTLTISSLQAEDVAVYYCHQHYTIP

SEQ ID NO: 692 - protein, 26 aa, Homo sapiens
DIVMTQSPDSLAVSLGERATVNCRAS

SEQ ID NO: 693 - protein, 12 aa, Homo sapiens
QSVLYNSNNKNY

SEQ ID NO: 694 - protein, 17 aa, Homo sapiens
LTWYQQKPGQSPKLLIY

SEQ ID NO: 695 - skipped

SEQ ID NO: 696 - protein, 36 aa, Homo sapiens
TRESGVPDRFSGSGSGTDFTLTISSLQAEDVAVYYC

SEQ ID NO: 697 - protein, 9 aa, Homo sapiens
HQHYTIPPT

SEQ ID NO: 698 - DNA, 564 bp, Homo sapiens
gacatcgtgatgacccagtctccagactccctggctgtgtctctgggcgagagggccaccgtcaactgcagggccagccagagtgtgttatacaactccaataataagaactacttaacttggtaccagcagaaaccagggcagtctcctaagttgctcatttactgggcatctacccgggaatccggggtccctgaccgattcagtggcagcgggtctgggacagacttcactctcaccatcagcagcctgcaggctgaagatgtggcagtttattactgtcaccaacattatactattccccccactttcggccctgggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagc

SEQ ID NO: 699 - protein, 113 aa, Homo sapiens
DIVMTQSPDSLAVSLGERATVNCRASQSVLYNSNNKNYLTWYQQKPGQSPKLLIYWASTRESGVPDRFSGSGSGTDFTLTISSLQAEDVAVYYCHQHYTIPPTFGPGTKVEIK

SEQ ID NO: 700 - protein, 10 aa, Homo sapiens
FGPGTKVEIK

SEQ ID NO: 701 - protein, 98 aa, Homo sapiens
QVQLVQSGAEVKKPGSSVKVSCKPSGDTSSTYAITWVRQAPGQGLEWMGQIIPLTGKDIYAQNFQGRVSITADESTNTVYMDLTGLTSDDTAVYFCAR

SEQ ID NO: 702 - protein, 25 aa, Homo sapiens
QVQLVQSGAEVKKPGSSVKVSCKPS

SEQ ID NO: 703 - protein, 8 aa, Homo sapiens
GDTSSTYA

SEQ ID NO: 704 - protein, 17 aa, Homo sapiens
ITWVRQAPGQGLEWMGQ

SEQ ID NO: 705 - protein, 8 aa, Homo sapiens
IIPLTGKD

SEQ ID NO: 706 - protein, 38 aa, Homo sapiens
IYAQNFQGRVSITADESTNTVYMDLTGLTSDDTAVYFC

SEQ ID NO: 707 - protein, 12 aa, Homo sapiens
ARRQVATYWFDP

SEQ ID NO: 708 - DNA, 562 bp, Homo sapiens
caggtgcagctggtgcagtctggggctgaggtgaagaagcctgggtcctcggtcaaggtctcctgcaagccttctggagacacctccagcacctatgctatcacctgggtgcgacaggcccctggacaaggccttgagtggatgggacagatcatccctctcaccggaaaagacatctacgcacagaacttccagggcagagtctcgattaccgcggacgaatccacgaacacagtctacatggacctgaccggcctgacatctgatgacacggccgtctatttctgtgcgagaagacaggtggctacatattggtttgacccctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtgg

SEQ ID NO: 709 - protein, 119 aa, Homo sapiens
QVQLVQSGAEVKKPGSSVKVSCKPSGDTSSTYAITWVRQAPGQGLEWMGQIIPLTGKDIYAQNFQGRVSITADESTNTVYMDLTGLTSDDTAVYFCARRQVATYWFDPWGQGTLVTVSS

SEQ ID NO: 710 - protein, 11 aa, Homo sapiens
WGQGTLVTVSS

SEQ ID NO: 711 - protein, 96 aa, Homo sapiens
SYELTQPPSVSVAPGQTATCTCGGDDIGSKTVHWYQQRPGQAPVLVISDDSARPSGIPARFSGSNSRNTATLTISSVEAGDEADYFCQVWDSNSGH

SEQ ID NO: 712 - protein, 25 aa, Homo sapiens
SYELTQPPSVSVAPGQTATCTCGGD

SEQ ID NO: 713 - protein, 6 aa, Homo sapiens
DIGSKT

SEQ ID NO: 714 - protein, 17 aa, Homo sapiens
VHWYQQRPGQAPVLVIS

SEQ ID NO: 715 - skipped

SEQ ID NO: 716 - protein, 36 aa, Homo sapiens
ARPSGIPARFSGSNSRNTATLTISSVEAGDEADYFC

SEQ ID NO: 717 - protein, 11 aa, Homo sapiens
QVWDSNSGHFV

SEQ ID NO: 718 - DNA, 480 bp, Homo sapiens
tcctatgagctgacacagcctccttcggtgtcagtggcccccggacagacggccacctgtacctgtgggggagacgacattggatccaaaactgtgcactggtaccagcagaggccaggccaggcccctgttctggtcatcagtgatgatagtgcccggccctcagggatccctgcacgattctctggctccaattctaggaacacggccaccctgaccatcagcagtgtcgaagccggggatgaggccgactatttctgtcaggtgtgggacagtaacagtggtcattttgtcttcggatctgggaccaaggtcaccgtcctaagtcagcccaaggccaaccccactgtcactctgttcccgccctcgagtgaggagcttcaagccaacaaggccacactggtgtgtctcataagtgacttctacccgggagccgtgacagtggcctggaaggcagatagcagccccgtcaaggcggga

SEQ ID NO: 719 - protein, 108 aa, Homo sapiens
SYELTQPPSVSVAPGQTATCTCGGDDIGSKTVHWYQQRPGQAPVLVISDDSARPSGIPARFSGSNSRNTATLTISSVEAGDEADYFCQVWDSNSGHFVFGSGTKVTVL

SEQ ID NO: 720 - protein, 10 aa, Homo sapiens
FGSGTKVTVL

SEQ ID NO: 721 - protein, 97 aa, Homo sapiens
EVQLLESGGGLVQPGGSLRLSCVASGFTFSNYPMVWVRQAPGKGLEWVSIIGGSYGGSYYADSVKGRFTISRDNSKNTLYLQMDNLRVEDTAVYYCA

SEQ ID NO: 722 - protein, 25 aa, Homo sapiens
EVQLLESGGGLVQPGGSLRLSCVAS

SEQ ID NO: 723 - protein, 8 aa, Homo sapiens
GFTFSNYP

SEQ ID NO: 724 - protein, 17 aa, Homo sapiens
MVWVRQAPGKGLEWVSI

SEQ ID NO: 725 - protein, 8 aa, Homo sapiens
IGGSYGGS

SEQ ID NO: 726 - protein, 38 aa, Homo sapiens
YYADSVKGRFTISRDNSKNTLYLQMDNLRVEDTAVYYC

SEQ ID NO: 727 - protein, 13 aa, Homo sapiens
ATSPATSGWWWAY

SEQ ID NO: 728 - DNA, 480 bp, Homo sapiens
gaggtgcagctgttggagtctgggggaggcttggtacagcctggggggtccctgagactctcgtgtgtagcctctggattcacttttagcaactatcccatggtctgggtccgccaggctccagggaaggggctggagtgggtctcaattattggtggtagttatgggggctcatattacgcagactccgtgaagggccggttcaccatctccagagacaattccaagaacaccctgtatctccaaatggacaacctgagagtcgaggacacggccgtctattactgtgcgacaagccccgcaaccagtggctggtggtgggcctactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcg

SEQ ID NO: 729 - protein, 120 aa, Homo sapiens
EVQLLESGGGLVQPGGSLRLSCVASGFTFSNYPMVWVRQAPGKGLEWVSIIGGSYGGSYYADSVKGRFTISRDNSKNTLYLQMDNLRVEDTAVYYCATSPATSGWWWAYWGQGTLVTVSS

SEQ ID NO: 730 - protein, 11 aa, Homo sapiens
WGQGTLVTVSS

SEQ ID NO: 731 - protein, 96 aa, Homo sapiens
  MOD_RES (39)..(39): Any amino acid
  MOD_RES (66)..(66): Any amino acid
EIVLTQSPAILSLSPGERATLSCRASQSVGRNYLAWYQXKPGQAPRVLIYGASSRATGTPDRFSGXGSGTDFTLTISRLEPEDFAVYYCHQYDIPP

SEQ ID NO: 732 - protein, 26 aa, Homo sapiens
EIVLTQSPAILSLSPGERATLSCRAS

SEQ ID NO: 733 - protein, 7 aa, Homo sapiens
QSVGRNY

SEQ ID NO: 734 - protein, 17 aa, Homo sapiens
  MOD_RES (6)..(6): Any amino acid
LAWYQXKPGQAPRVLIY

SEQ ID NO: 735 - skipped

SEQ ID NO: 736 - protein, 36 aa, Homo sapiens
  MOD_RES (13)..(13): Any amino acid
SRATGTPDRFSGXGSGTDFTLTISRLEPEDFAVYYC

SEQ ID NO: 737 - protein, 9 aa, Homo sapiens
HQYDIPPQT

SEQ ID NO: 738 - DNA, 563 bp, Homo sapiens
  modified_base (115)..(115): a, c, t, g, unknown or other
  misc_feature (115)..(115): a, c, t, g, unknown or other
  modified_base (196)..(196): a, c, t, g, unknown or other
  misc_feature (196)..(196): a, c, t, g, unknown or other
gaaattgtgttgacgcagtctccagccatcctgtctttgtctccaggggaaagagccaccctctcctgcagggccagtcagagtgttggcagaaattacttagcctggtaccagnagaaacctggccaggctcccagggtcctcatttatggtgcatccagcagggccactggcaccccagacaggttcagtggcngtgggtctgggacagacttcacgctcaccatcagcagactggagcctgaagattttgcggtgtattactgtcatcagtatgatatcccacctcagacttttggccaggggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacga

SEQ ID NO: 739 - protein, 108 aa, Homo sapiens
  MOD_RES (39)..(39): Any amino acid
  MOD_RES (66)..(66): Any amino acid
EIVLTQSPAILSLSPGERATLSCRASQSVGRNYLAWYQXKPGQAPRVLIYGASSRATGTPDRFSGXGSGTDFTLTISRLEPEDFAVYYCHQYDIPPQTFGQGTKVEIK

SEQ ID NO: 740 - protein, 10 aa, Homo sapiens
FGQGTKVEIK

SEQ ID NO: 741 - protein, 97 aa, Homo sapiens
EVQLLESGGGLVQPGGSLRLSCAASGFTLGDYSMTWVRQAPGKGLEWVSSIRKSGGDTFYTDSVKGRFTISRDTPKNTLFLQMNSLRGEDTAVYFCA

SEQ ID NO: 742 - protein, 25 aa, Homo sapiens
EVQLLESGGGLVQPGGSLRLSCAAS

SEQ ID NO: 743 - protein, 8 aa, Homo sapiens
GFTLGDYS

SEQ ID NO: 744 - protein, 17 aa, Homo sapiens
MTWVRQAPGKGLEWVSS

SEQ ID NO: 745 - protein, 8 aa, Homo sapiens
IRKSGGDT

SEQ ID NO: 746 - protein, 38 aa, Homo sapiens
FYTDSVKGRFTISRDTPKNTLFLQMNSLRGEDTAVYFC

SEQ ID NO: 747 - protein, 16 aa, Homo sapiens
ARPTPYGTTWFGRVDS

SEQ ID NO: 748 - DNA, 400 bp, Homo sapiens
gaggtgcagctgttggagtctgggggaggcttggtacagcctggggggtccctgagactctcctgtgcagcctctggattcacccttggagactattccatgacctgggtccgccaggctccagggaaggggctggagtgggtctcaagtattaggaaaagtggcggtgacacattctacacagactccgtgaagggccggttcaccatctccagagacactcccaagaacacactgtttctgcaaatgaacagcctgagaggcgaggacacggccgtatatttctgtgcgagaccaaccccgtatggcaccacttggtttgggcgggttgactcctggggccagggaaccctggtcaccgtctcctcagcgtcgaccaagggcccatcggtcttccccc

SEQ ID NO: 749 - protein, 123 aa, Homo sapiens
EVQLLESGGGLVQPGGSLRLSCAASGFTLGDYSMTWVRQAPGKGLEWVSSIRKSGGDTFYTDSVKGRFTISRDTPKNTLFLQMNSLRGEDTAVYFCARPTPYGTTWFGRVDSWGQGTLVTVSS

SEQ ID NO: 750 - protein, 11 aa, Homo sapiens
WGQGTLVTVSS

SEQ ID NO: 751 - protein, 94 aa, Homo sapiens
DIQMTQSPSSLSASLGDRVTITCRTSQSISNYLNWYQQKPGKAPKLLIYATSSLHSGVPSRFSGSGSGTDFTLTISSLQPEDFASYYCQQTYRT

SEQ ID NO: 752 - protein, 26 aa, Homo sapiens
DIQMTQSPSSLSASLGDRVTITCRTS

SEQ ID NO: 753 - protein, 6 aa, Homo sapiens
QSISNY

SEQ ID NO: 754 - protein, 17 aa, Homo sapiens
LNWYQQKPGKAPKLLIY

SEQ ID NO: 755 - skipped

SEQ ID NO: 756 - protein, 36 aa, Homo sapiens
SLHSGVPSRFSGSGSGTDFTLTISSLQPEDFASYYC

SEQ ID NO: 757 - protein, 9 aa, Homo sapiens
QQTYRTPIT

SEQ ID NO: 758 - DNA, 565 bp, Homo sapiens
  modified_base (553)..(553): a, c, t, g, unknown or other
  misc_feature (553)..(553): a, c, t, g, unknown or other
gacatccagatgacccagtctccatcctccctgtctgcatctcttggagacagagtcaccatcacttgccggacaagtcaaagcattagtaactacttgaattggtatcagcagaaaccagggaaagcccctaaactcctgatctatgctacatccagcttgcatagtggggtcccatcaagattcagtggcagtggatctgggacagatttcactctcaccatcagcagtctgcaacctgaagattttgcaagttattactgtcaacagacttacaggaccccaatcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcanactacgagaaac

SEQ ID NO: 759 - protein, 107 aa, Homo sapiens
DIQMTQSPSSLSASLGDRVTITCRTSQSISNYLNWYQQKPGKAPKLLIYATSSLHSGVPSRFSGSGSGTDFTLTISSLQPEDFASYYCQQTYRTPITFGPGTKVDIK

SEQ ID NO: 760 - protein, 10 aa, Homo sapiens
FGPGTKVDIK

SEQ ID NO: 761 - protein, 98 aa, Homo sapiens
EVQLVQSGAEVKKPGESLRISCKASGYSFTSSWINWVRQKAGKGLEWMGRLNPSDSYPNYSPSFQGHVTISADNSVTTAYLQWSSLKASDTAIYYCTR

SEQ ID NO: 762 - protein, 25 aa, Homo sapiens
EVQLVQSGAEVKKPGESLRISCKAS

SEQ ID NO: 763 - protein, 8 aa, Homo sapiens
GYSFTSSW

SEQ ID NO: 764 - protein, 17 aa, Homo sapiens
INWVRQKAGKGLEWMGR

SEQ ID NO: 765 - protein, 8 aa, Homo sapiens
LNPSDSYP

SEQ ID NO: 766 - protein, 38 aa, Homo sapiens
NYSPSFQGHVTISADNSVTTAYLQWSSLKASDTAIYYC

SEQ ID NO: 767 - protein, 17 aa, Homo sapiens
TRDSFYDVDLSSFYMDV

SEQ ID NO: 768 - DNA, 481 bp, Homo sapiens
gaagtgcagctggtgcagtctggagcagaggtgaaaaagcccggggagtctctgaggatctcctgtaaggcttctggatacagctttaccagttcctggatcaactgggtgcgccagaaggccgggaaaggcctggagtggatggggaggcttaatcctagtgactcttaccccaactacagcccgtccttccaaggccacgtcaccatctcagctgacaactccgtcaccactgcctacctgcagtggagcagcctgaaggcctcggacaccgccatatattactgtacaagagattccttttacgatgtggacctgtcctccttctacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctg

SEQ ID NO: 769 - protein, 124 aa, Homo sapiens
EVQLVQSGAEVKKPGESLRISCKASGYSFTSSWINWVRQKAGKGLEWMGRLNPSDSYPNYSPSFQGHVTISADNSVTTAYLQWSSLKASDTAIYYCTRDSFYDVDLSSFYMDVWGKGTTVTVSS

SEQ ID NO: 770 - protein, 11 aa, Homo sapiens
WGKGTTVTVSS

SEQ ID NO: 771 - protein, 95 aa, Homo sapiens
EIVLTQSPGTLSLSPGERATLSCRASQSLSNSYLAWYQQKPGQAPRLLIYGASNRATGIPDRFSGSGSGTDFTLTISRLEPEDFAVFYCQQYGSS

SEQ ID NO: 772 - protein, 26 aa, Homo sapiens [sequence omitted]

SEQ ID NO: 773 - protein, 7 aa, Homo sapiens
QSLSNSY

SEQ ID NO: 774 - protein, 17 aa, Homo sapiens
LAWYQQKPGQAPRLLIY

SEQ ID NO: 775 - skipped

SEQ ID NO: 776 - protein, 36 aa, Homo sapiens
NRATGIPDRFSGSGSGTDFTLTISRLEPEDFAVFYC

SEQ ID NO: 777 - protein, 9 aa, Homo sapiens
QQYGSSRHT

SEQ ID NO: 778 - DNA, 483 bp, Homo sapiens
gaaattgtgttgacgcagtctccaggcaccctgtctttgtctccaggggaaagagccaccctctcctgcagggccagtcagagtcttagcaacagctacttagcctggtatcagcagaaacctggccaggctcccaggctcctcatctatggtgcatccaacagggccactggcatcccagacaggttcagtggcagtgggtctgggacagacttcactctcaccatcagcagactggagcctgaagattttgcggtgttttactgtcagcaatatggttcgtcacggcacacttttggccaggggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccag

SEQ ID NO: 779 - protein, 108 aa, Homo sapiens
EIVLTQSPGTLSLSPGERATLSCRASQSLSNSYLAWYQQKPGQAPRLLIYGASNRATGIPDRFSGSGSGTDFTLTISRLEPEDFAVFYCQQYGSSRHTFGQGTKVEIK

SEQ ID NO: 780 - protein, 10 aa, Homo sapiens
FGQGTKVEIK

SEQ ID NO: 781 - protein, 98 aa, Homo sapiens
QVQLVQSGGEVKKPGASVKVSCKASGYTFTSHGISWVRQAPGQGLEWLGWISVYNGDTNYAQKVQDRLTVTTDTSTSTVYMELRSLRSDDTAVYYCAR

SEQ ID NO: 782 - protein, 25 aa, Homo sapiens
QVQLVQSGGEVKKPGASVKVSCKAS

SEQ ID NO: 783 - protein, 8 aa, Homo sapiens
GYTFTSHG

SEQ ID NO: 784 - protein, 17 aa, Homo sapiens
ISWVRQAPGQGLEWLGW

SEQ ID NO: 785 - protein, 8 aa, Homo sapiens
ISVYNGDT

SEQ ID NO: 786 - protein, 38 aa, Homo sapiens
NYAQKVQDRLTVTTDTSTSTVYMELRSLRSDDTAVYYC

SEQ ID NO: 787 - protein, 15 aa, Homo sapiens
ARDRIDYVVYDAFDI

SEQ ID NO: 788 - DNA, 480 bp, Homo sapiens
caggtgcagctggtgcagtctggaggtgaggtgaagaagcctggggcctcagtgaaggtctcctgcaaggcttctggttacacctttaccagtcatggtattagttgggtgcgacaggcccctggacaagggcttgagtggttgggatggatcagcgtttacaatggtgacacaaactatgcacagaaggtccaagacagactcaccgtgaccacagacacgtccacgagcacagtttacatggagctgaggagcctgagatctgacgacacggccgtgtattactgtgcgagagatagaattgactatgtggtgtatgatgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacg

SEQ ID NO: 789 - protein, 122 aa, Homo sapiens
QVQLVQSGGEVKKPGASVKVSCKASGYTFTSHGISWVRQAPGQGLEWLGWISVYNGDTNYAQKVQDRLTVTTDTSTSTVYMELRSLRSDDTAVYYCARDRIDYVVYDAFDIWGQGTMVTVSS

SEQ ID NO: 790 - protein, 11 aa, Homo sapiens
WGQGTMVTVSS

SEQ ID NO: 791 - protein, 93 aa, Homo sapiens
DIQMTQSPSTLSASVGDRVTITCRASQRISGWLAWYQQKPGKAPKLLIHRASILESGVSSRFSGSGSGTEFTLTISSLQPDDSATYYCQLYDD

SEQ ID NO: 792 - protein, 26 aa, Homo sapiens
DIQMTQSPSTLSASVGDRVTITCRAS

SEQ ID NO: 793 - protein, 6 aa, Homo sapiens
QRISGW

SEQ ID NO: 794 - protein, 17 aa, Homo sapiens
LAWYQQKPGKAPKLLIH

SEQ ID NO: 795 - skipped

SEQ ID NO: 796 - protein, 36 aa, Homo sapiens
ILESGVSSRFSGSGSGTEFTLTISSLQPDDSATYYC

SEQ ID NO: 797 - protein, 8 aa, Homo sapiens
QLYDDFRT

SEQ ID NO: 798 - DNA, 483 bp, Homo sapiens
gacatccagatgacccagtctccttccaccctgtctgcatctgtaggagacagagtcaccatcacttgccgggccagtcagaggattagtggctggttggcctggtatcagcagaaaccagggaaagcccctaaactcttgatccatagggcatcaattttagagagtggggtctcatcaaggttcagcggcagtggatctgggacagaattcactctgaccatcagcagcctgcagcctgatgattctgcaacttattactgtcaactgtatgatgatttccggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagt

SEQ ID NO: 799 - protein, 106 aa, Homo sapiens
DIQMTQSPSTLSASVGDRVTITCRASQRISGWLAWYQQKPGKAPKLLIHRASILESGVSSRFSGSGSGTEFTLTISSLQPDDSATYYCQLYDDFRTFGQGTKVEIK

SEQ ID NO: 800 - protein, 10 aa, Homo sapiens
FGQGTKVEIK

SEQ ID NO: 801 - protein, 98 aa, Homo sapiens
EVQLVESGGGLVQPGGSLTLSCAASGFTFRSYWMHWVRQVPGKGPVWLSRINNDGSSSRYADSVKGRFFITRDSAKNTVFLQLNSLRVEDTAIYYCAR

SEQ ID NO: 802 - protein, 25 aa, Homo sapiens
EVQLVESGGGLVQPGGSLTLSCAAS

SEQ ID NO: 803 - protein, 8 aa, Homo sapiens
GFTFRSYW

SEQ ID NO: 804 - protein, 17 aa, Homo sapiens
MHWVRQVPGKGPVWLSR

SEQ ID NO: 805 - protein, 8 aa, Homo sapiens
INNDGSSS

SEQ ID NO: 806 - protein, 38 aa, Homo sapiens
RYADSVKGRFFITRDSAKNTVFLQLNSLRVEDTAIYYC

SEQ ID NO: 807 - protein, 13 aa, Homo sapiens
ARGDLVSTANFDY

SEQ ID NO: 808 - DNA, 480 bp, Homo sapiens
gaggtgcagctggtggagtccgggggaggcttagttcagccgggggggtccctgacactgtcctgtgcagcctctggattcaccttcaggagctactggatgcactgggtccgccaagttccaggcaaggggccggtgtggctctcacgtattaacaatgatggcagtagctcgaggtacgcggactccgtgaagggccgcttcttcatcaccagagatagcgccaagaacacggtgttcctccaactgaacagtctcagagtcgaggacacggccatttattactgtgcaagaggagatttagtctctacggccaactttgactactggggccggggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcg

SEQ ID NO: 809 - protein, 120 aa, Homo sapiens
EVQLVESGGGLVQPGGSLTLSCAASGFTFRSYWMHWVRQVPGKGPVWLSRINNDGSSSRYADSVKGRFFITRDSAKNTVFLQLNSLRVEDTAIYYCARGDLVSTANFDYWGRGTLVTVSS

SEQ ID NO: 810 - protein, 11 aa, Homo sapiens
WGRGTLVTVSS

SEQ ID NO: 811 - protein, 94 aa, Homo sapiens
EIVLTQSPGTLSLSPGERATLSCRASQRVDRSYLAWYRQKPGQAPSLLISGTSTRAPGIADRFIGSGSGTDFTLTISGLEPEDFAVYYCQQYEN

SEQ ID NO: 812 - protein, 26 aa, Homo sapiens [sequence omitted]

SEQ ID NO: 813 - protein, 7 aa, Homo sapiens
QRVDRSY

SEQ ID NO: 814 - protein, 17 aa, Homo sapiens
LAWYRQKPGQAPSLLIS

SEQ ID NO: 815 - skipped

SEQ ID NO: 816 - protein, 36 aa, Homo sapiens
TRAPGIADRFIGSGSGTDFTLTISGLEPEDFAVYYC

SEQ ID NO: 817 - protein, 15 aa, Homo sapiens
QQYENSQHGSSPPYT

SEQ ID NO: 818 - DNA, 562 bp, Homo sapiens
gaaattgtgttgacgcagtctccaggcaccctgtctttgtctccaggggaaagagccaccctctcctgcagggccagtcagagagttgacaggagctacttagcctggtaccgccaaaaacctggccaggctcccagcctcctcatctccgggacatccaccagggcccctggcatcgccgacagattcattggcagtgggtctgggacagacttcactctcaccatcagcggactggagcctgaagattttgcagtatattactgtcagcagtatgaaaattcgcaacatggaagttcacccccgtacacttttggccaggggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgc

SEQ ID NO: 819 - protein, 114 aa, Homo sapiens
EIVLTQSPGTLSLSPGERATLSCRASQRVDRSYLAWYRQKPGQAPSLLISGTSTRAPGIADRFIGSGSGTDFTLTISGLEPEDFAVYYCQQYENSQHGSSPPYTFGQGTKVEIK

SEQ ID NO: 820 - protein, 10 aa, Homo sapiens
FGQGTKVEIK

SEQ ID NO: 821 - protein, 98 aa, Homo sapiens
EVQLVESGGKVVQPGGSLRLSCAASGFTFSSSWMHWVRQAPGQGLVWVSRINSAGSSKSYADSVKGRFTISRDNAKNTLYLQMNSLRGEDTAVYYCAR

SEQ ID NO: 822 - protein, 25 aa, Homo sapiens
EVQLVESGGKVVQPGGSLRLSCAAS

SEQ ID NO: 823 - protein, 8 aa, Homo sapiens
GFTFSSSW

SEQ ID NO: 824 - protein, 17 aa, Homo sapiens
MHWVRQAPGQGLVWVSR

SEQ ID NO: 825 - protein, 8 aa, Homo sapiens
INSAGSSK

SEQ ID NO: 826 - protein, 38 aa, Homo sapiens
SYADSVKGRFTISRDNAKNTLYLQMNSLRGEDTAVYYC

SEQ ID NO: 827 - protein, 16 aa, Homo sapiens
ARDHDYGDYRGNAFDM

SEQ ID NO: 828 - DNA, 479 bp, Homo sapiens
gaggtgcagctggtggagtccgggggaaaggtcgttcagccgggggggtccctgagactctcctgtgcagcctctggattcaccttcagtagttcctggatgcactgggtccgccaagctccagggcaggggctggtgtgggtctcacgtattaacagtgctgggagtagcaaaagctacgcggactccgtgaagggccgattcaccatctccagagacaacgccaagaacacgctgtatctgcaaatgaacagtctgagaggcgaggacacggctgtgtattactgtgcaagagatcatgactacggtgactacagagggaacgcttttgatatgtggggcctagggacaatggtcaccgtctcttcagcgtcgaccaagggcccatcggtcttccccctggcaccctcctccaagagcacctctgggggcacagcggccctgggctgcctggtcaaggactacttccccgaacctgt

SEQ ID NO: 829 - protein, 123 aa, Homo sapiens
EVQLVESGGKVVQPGGSLRLSCAASGFTFSSSWMHWVRQAPGQGLVWVSRINSAGSSKSYADSVKGRFTISRDNAKNTLYLQMNSLRGEDTAVYYCARDHDYGDYRGNAFDMWGLGTMVTVSS

SEQ ID NO: 830 - protein, 11 aa, Homo sapiens
WGLGTMVTVSS

SEQ ID NO: 831 - protein, 90 aa, Homo sapiens
DIQMTQSPSSLSASVGDRVTITCQASQDISNYLNWYQQKPGKAPKLLIYDASKLETGVPSRFSGRQSGTDYTFTISSLQPEDFATYFCQQ

SEQ ID NO: 832 - protein, 26 aa, Homo sapiens
DIQMTQSPSSLSASVGDRVTITCQAS

SEQ ID NO: 833 - protein, 6 aa, Homo sapiens
QDISNY

SEQ ID NO: 834 - protein, 17 aa, Homo sapiens
LNWYQQKPGKAPKLLIY

SEQ ID NO: 835 - skipped

SEQ ID NO: 836 - protein, 36 aa, Homo sapiens
KLETGVPSRFSGRQSGTDYTFTISSLQPEDFATYFC

SEQ ID NO: 837 - protein, 5 aa, Homo sapiens
QQLHT

SEQ ID NO: 838 - DNA, 484 bp, Homo sapiens
gacatccagatgacccagtctccatcctccctgtctgcatctgtgggagacagagtcaccatcacttgccaggcgagtcaggacattagcaactatttaaattggtatcagcagaaaccagggaaagcccctaagctcctgatctacgatgcatccaaattggaaacaggggtcccatcaaggttcagtggaagacaatctgggacagattatactttcaccatcagcagcctgcagcctgaagattttgcaacatatttctgtcaacagcttcatactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagc

SEQ ID NO: 839 - protein, 103 aa, Homo sapiens
DIQMTQSPSSLSASVGDRVTITCQASQDISNYLNWYQQKPGKAPKLLIYDASKLETGVPSRFSGRQSGTDYTFTISSLQPEDFATYFCQQLHTFGGGTKVEIK

SEQ ID NO: 840 - protein, 10 aa, Homo sapiens
FGGGTKVEIK

SEQ ID NO: 841 - protein, 98 aa, Homo sapiens
QVQLVQSGAEVKRPGASLKVSCKASGYSFTTYGITWVRQAPGQGLEWMGWISTYNGYTNYAQRLQGRVTMTTDTSTGTAYLELRSLTYDDTAVYYCAR

SEQ ID NO: 842 - protein, 25 aa, Homo sapiens
QVQLVQSGAEVKRPGASLKVSCKAS

SEQ ID NO: 843 - protein, 8 aa, Homo sapiens
GYSFTTYG

SEQ ID NO: 844 - protein, 17 aa, Homo sapiens
ITWVRQAPGQGLEWMGW

SEQ ID NO: 845 - protein, 8 aa, Homo sapiens
ISTYNGYT

SEQ ID NO: 846 - protein, 38 aa, Homo sapiens
NYAQRLQGRVTMTTDTSTGTAYLELRSLTYDDTAVYYC

SEQ ID NO: 847 - protein, 16 aa, Homo sapiens
ARRGDYGDYRGDAFDI

SEQ ID NO: 848 - DNA, 479 bp, Homo sapiens
caggtgcagctggtgcagtctggagctgaggtgaagaggcctggggcctcactgaaggtctcctgcaaggcctctggttacagctttaccacctacgggatcacctgggtgcgacaggcccctggacaagggcttgagtggatgggatggatcagcacttacaatggttacacaaactatgcacagagactccagggcagagtcaccatgaccacagacacatccactgggacagcctacttggagctgaggagcctgacatatgacgacacggccgtctattattgtgcgagacgtggggactacggtgactaccggggtgatgcatttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgt

SEQ ID NO: 849 - protein, 123 aa, Homo sapiens
QVQLVQSGAEVKRPGASLKVSCKASGYSFTTYGITWVRQAPGQGLEWMGWISTYNGYTNYAQRLQGRVTMTTDTSTGTAYLELRSLTYDDTAVYYCARRGDYGDYRGDAFDIWGQGTMVTVSS

SEQ ID NO: 850 - protein, 11 aa, Homo sapiens
WGQGTMVTVSS

SEQ ID NO: 851 - protein, 90 aa, Homo sapiens
DIQMTQSPSSLSASVGDRVTITCQASQDVSNYLNWYQQKPGKAPKLLIYDTSNLETGVPSRFSGTGSGTDFTFTISSLQPEDVATYFCQQ

SEQ ID NO: 852 - protein, 26 aa, Homo sapiens
DIQMTQSPSSLSASVGDRVTITCQAS

SEQ ID NO: 853 - protein, 6 aa, Homo sapiens
QDVSNY

SEQ ID NO: 854 - protein, 17 aa, Homo sapiens
LNWYQQKPGKAPKLLIY

SEQ ID NO: 855 - skipped

SEQ ID NO: 856 - protein, 36 aa, Homo sapiens
NLETGVPSRFSGTGSGTDFTFTISSLQPEDVATYFC

SEQ ID NO: 857 - protein, 5 aa, Homo sapiens
QQVFT

SEQ ID NO: 858 - DNA, 484 bp, Homo sapiens
gacatccagatgacccagtctccatcctccctgtctgcatctgtaggcgacagagtcaccatcacttgccaggcgagtcaggacgttagcaactatttaaattggtatcagcagaaaccagggaaagcccctaaactcctgatctacgatacatccaatttggaaacaggggtcccatcaaggttcagtggaactggatctgggacagattttactttcaccatcagcagcctgcagcctgaagatgttgcaacatatttctgtcaacaggttttcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagc

SEQ ID NO: 859 - protein, 103 aa, Homo sapiens
DIQMTQSPSSLSASVGDRVTITCQASQDVSNYLNWYQQKPGKAPKLLIYDTSNLETGVPSRFSGTGSGTDFTFTISSLQPEDVATYFCQQVFTFGPGTKVDIK

SEQ ID NO: 860 - protein, 10 aa, Homo sapiens
FGPGTKVDIK

SEQ ID NO: 861 - protein, 98 aa, Homo sapiens
EVQLVESGGGLVKPGGSLRLSCAASGFIFSDYTMNWVRQVPGKGLEWVSSISSYSGYIYYADSVKGRFTLSRDNAKKSLYLQMNNLRAEDTAVYYCAK

SEQ ID NO: 862 - protein, 25 aa, Homo sapiens
EVQLVESGGGLVKPGGSLRLSCAAS

SEQ ID NO: 863 - protein, 8 aa, Homo sapiens
GFIFSDYT

SEQ ID NO: 864 - protein, 17 aa, Homo sapiens
MNWVRQVPGKGLEWVSS

SEQ ID NO: 865 - protein, 8 aa, Homo sapiens
ISSYSGYI

SEQ ID NO: 866 - protein, 38 aa, Homo sapiens
YYADSVKGRFTLSRDNAKKSLYLQMNNLRAEDTAVYYC

SEQ ID NO: 867 - protein, 27 aa, Homo sapiens
AKDRVRDGDNDWDSVDATYWGYGVFDT

SEQ ID NO: 868 - DNA, 480 bp, Homo sapiens
gaggtgcagctggtggagtctgggggaggcctggtcaagcctggggggtccctgagactgtcttgtgcagcctctggattcatattcagtgactataccatgaattgggtccgccaggttccagggaagggcctggagtgggtctcaagtattagtagttacagtggttacatatactacgcagactcagtgaagggccgcttcaccctttccagagacaacgccaagaagtcactgtatctgcaaatgaacaacctgagagccgaggacacggctgtctattactgtgcgaaagatagggtgcgagatggcgacaatgactgggattcagtggacgccacttactggggttacggtgtttttgatacctcgggccaagggacaatggtcaccgtctcttcagcgtcgaccaagggcccatcggtcttccccctggcaccctcctccaagagcacctctgggggcacagcggccctgggc

SEQ ID NO: 869 - protein, 134 aa, Homo sapiens
EVQLVESGGGLVKPGGSLRLSCAASGFIFSDYTMNWVRQVPGKGLEWVSSISSYSGYIYYADSVKGRFTLSRDNAKKSLYLQMNNLRAEDTAVYYCAKDRVRDGDNDWDSVDATYWGYGVFDTSGQGTMVTVSS

SEQ ID NO: 870 - protein, 11 aa, Homo sapiens
SGQGTMVTVSS

SEQ ID NO: 871 - protein, 101 aa, Homo sapiens
DIVMTQSPDSLAVSLGERATINCKSSQSVLYGSNNKNYFAWYQQKPGQPPKMLIYWASTRESGVPDRFSGSGSGTDFTLTISSLQAEDVAVYYCQQHYRIP

SEQ ID NO: 872 - protein, 26 aa, Homo sapiens
DIVMTQSPDSLAVSLGERATINCKSS

SEQ ID NO: 873 - protein, 12 aa, Homo sapiens
QSVLYGSNNKNY

SEQ ID NO: 874 - protein, 17 aa, Homo sapiens
FAWYQQKPGQPPKMLIY

SEQ ID NO: 875 - skipped

SEQ ID NO: 876 - protein, 36 aa, Homo sapiens; identical to SEQ ID NO: 696

SEQ ID NO: 877 - protein, 9 aa, Homo sapiens
QQHYRIPQT

SEQ ID NO: 878 - DNA, 563 bp, Homo sapiens
gacatcgtgatgacccagtctccagactccctggctgtgtctctgggcgagagggccaccatcaactgcaagtccagccagagtgttttatacggctccaacaataagaactactttgcttggtaccagcagaaaccaggacagcctcctaagatgctcatttactgggcatctacccgggaatccggggtccctgaccgcttcagtggcagcgggtctgggacagatttcactctcaccatcagcagcctgcaggctgaagatgtggcagtttattactgtcagcaacattatagaattcctcagacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgag

SEQ ID NO: 879 - protein, 113 aa, Homo sapiens
DIVMTQSPDSLAVSLGERATINCKSSQSVLYGSNNKNYFAWYQQKPGQPPKMLIYWASTRESGVPDRFSGSGSGTDFTLTISSLQAEDVAVYYCQQHYRIPQTFGQGTKVEIK

SEQ ID NO: 880 - protein, 10 aa, Homo sapiens
FGQGTKVEIK

SEQ ID NO: 881 - protein, 98 aa, Homo sapiens
EVQLVESGGGLVQPGGSLRLSCAASGFSFSSFWMHWVRQVPGKGLLWVARINNDGTFTTYADSVKGRFTISRDNAKNTLNLHMSNLRVEDSALYFCVR

SEQ ID NO: 882 - protein, 25 aa, Homo sapiens [sequence omitted]

SEQ ID NO: 883 - protein, 8 aa, Homo sapiens
GFSFSSFW

SEQ ID NO: 884 - protein, 17 aa, Homo sapiens
MHWVRQVPGKGLLWVAR

SEQ ID NO: 885 - protein, 8 aa, Homo sapiens
INNDGTFT

SEQ ID NO: 886 - protein, 38 aa, Homo sapiens
TYADSVKGRFTISRDNAKNTLNLHMSNLRVEDSALYFC

SEQ ID NO: 887 - protein, 16 aa, Homo sapiens
VRDNDYGDYRGNAFDI

SEQ ID NO: 888 - DNA, 480 bp, Homo sapiens
gaggtgcagctggtggagtccgggggaggcttagttcagccgggggggtccctgagactctcctgtgcagcctctggattctccttcagtagtttctggatgcactgggtccgccaagttccagggaagggactgctgtgggtcgcacgtattaacaacgatgggactttcacaacctacgcggactctgtgaagggccgattcaccatctccagagacaacgccaagaatacgctgaatctgcacatgagcaatctcagagtcgaggattcggctctgtatttctgtgtaagagataatgactacggcgactacagagggaacgcttttgatatttggggccaggggacaatggtcaccgtctcttcagcgtcgaccaagggcccatcggtcttccccctggcaccctcctccaagagcacctctgggggcacagcggccctgggctgcctggtcaaggactacttccccgaacctgtg

SEQ ID NO: 889 - protein, 123 aa, Homo sapiens
EVQLVESGGGLVQPGGSLRLSCAASGFSFSSFWMHWVRQVPGKGLLWVARINNDGTFTTYADSVKGRFTISRDNAKNTLNLHMSNLRVEDSALYFCVRDNDYGDYRGNAFDIWGQGTMVTVSS

SEQ ID NO: 890 - protein, 11 aa, Homo sapiens
WGQGTMVTVSS

SEQ ID NO: 891 - protein, 90 aa, Homo sapiens
DIQMTQSPSSLSASVGDRVTITCQASQDMSNYLNWYQQKSGKAPKLLIYDTSKLEAGVPSRFSGSGFGTHYVLSITSLQPEDIATYYCEQ

SEQ ID NO: 892 - protein, 26 aa, Homo sapiens
DIQMTQSPSSLSASVGDRVTITCQAS

SEQ ID NO: 893 - protein, 6 aa, Homo sapiens
QDMSNY

SEQ ID NO: 894 - protein, 17 aa, Homo sapiens
LNWYQQKSGKAPKLLIY

SEQ ID NO: 895 - skipped

SEQ ID NO: 896 - protein, 36 aa, Homo sapiens
KLEAGVPSRFSGSGFGTHYVLSITSLQPEDIATYYC

SEQ ID NO: 897 - protein, 5 aa, Homo sapiens
EQLHT

SEQ ID NO: 898 - DNA, 564 bp, Homo sapiens
gacatccagatgacccagtctccatcctccctgtctgcatctgtaggagacagagtcaccatcacttgccaggcgagtcaggacatgagcaactatttaaattggtatcagcaaaaatcagggaaagcccctaagctcctgatttacgatacttccaaattggaagcaggggtcccatcaaggttcagtggcagtggatttgggacacattatgttttaagcatcaccagtctacagcctgaagatattgcaacatattactgtgaacagcttcatactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctac

SEQ ID NO: 899 - protein, 103 aa, Homo sapiens
DIQMTQSPSSLSASVGDRVTITCQASQDMSNYLNWYQQKSGKAPKLLIYDTSKLEAGVPSRFSGSGFGTHYVLSITSLQPEDIATYYCEQLHTFGGGTKVEIK

SEQ ID NO: 900 - protein, 10 aa, Homo sapiens
FGGGTKVEIK

SEQ ID NO: 901 - protein, 98 aa, Homo sapiens
EVQLVESGGGLVKPGGSLRISCSSSGFTFSDYTMNWVRQAPGKGLEWVSSISSRSGYIYYADSVKGRFTISRDNAKNSLYLQMNSLRAEDTAVYYCAR

SEQ ID NO: 902 - protein, 25 aa, Homo sapiens
EVQLVESGGGLVKPGGSLRISCSSS

SEQ ID NO: 903 - protein, 8 aa, Homo sapiens
GFTFSDYT

SEQ ID NO: 904 - protein, 17 aa, Homo sapiens
MNWVRQAPGKGLEWVSS

SEQ ID NO: 905 - protein, 8 aa, Homo sapiens
ISSRSGYI

SEQ ID NO: 906 - protein, 38 aa, Homo sapiens
YYADSVKGRFTISRDNAKNSLYLQMNSLRAEDTAVYYC

SEQ ID NO: 907 - protein, 27 aa, Homo sapiens
ARDRVRDGDNYWDSVDATYWGYGAFDI

SEQ ID NO: 908 - DNA, 480 bp, Homo sapiens
gaggtgcagctggtggagtctgggggaggcctggtcaagcctggggggtccctaagaatctcatgttcatcctctggattcaccttcagtgactataccatgaattgggtccgccaggctccagggaaggggctggagtgggtctcatccattagtagtagaagtggttatatatactacgcagactcagtgaagggccgattcaccatctccagagacaacgccaagaactcactgtatttgcaaatgaacagcctgagagccgaggacacggctgtctattactgtgcgagagatagggtgcgagatggcgacaattactgggattcagtggacgccacttactggggttacggtgcttttgatatctgcggccacgggacaatggtcaccgtctcttcagcgtcgaccaagggcccatcggtcttccccctggcaccctcctccaagagcacctctgggggcacagcggccctgggc

SEQ ID NO: 909 - protein, 134 aa, Homo sapiens
EVQLVESGGGLVKPGGSLRISCSSSGFTFSDYTMNWVRQAPGKGLEWVSSISSRSGYIYYADSVKGRFTISRDNAKNSLYLQMNSLRAEDTAVYYCARDRVRDGDNYWDSVDATYWGYGAFDICGHGTMVTVSS

SEQ ID NO: 910 - protein, 11 aa, Homo sapiens
CGHGTMVTVSS

SEQ ID NO: 911 - protein, 101 aa, Homo sapiens
DIVMTQSPDSLAVSLGERATINCKSSQSVLYSSNNKNYFAWYQQRPGQPPKLLIYWASTRESGVPDRFSGSGSGTDFTLTISGLQAEDVAVYYCQQHFTTP

SEQ ID NO: 912 - protein, 26 aa, Homo sapiens
DIVMTQSPDSLAVSLGERATINCKSS

SEQ ID NO: 913 - protein, 12 aa, Homo sapiens
QSVLYSSNNKNY

SEQ ID NO: 914 - protein, 17 aa, Homo sapiens
FAWYQQRPGQPPKLLIY

SEQ ID NO: 915 - skipped

SEQ ID NO: 916 - protein, 36 aa, Homo sapiens
TRESGVPDRFSGSGSGTDFTLTISGLQAEDVAVYYC

SEQ ID NO: 917 - protein, 9 aa, Homo sapiens
QQHFTTPQT

SEQ ID NO: 918 - DNA, 483 bp, Homo sapiens
gacatcgtgatgacccagtctccagactccctggctgtgtctctgggcgagagggccaccatcaactgcaagtccagccagagtgttttatacagctccaacaataagaactactttgcttggtaccagcagagaccaggacagcctcctaaactgctcatttactgggcatctacccgggaatccggggtccctgaccgtttcagtggcagcgggtctgggacagatttcacgctcaccatcagcggcctgcaggctgaagatgtggcagtttattactgtcagcaacattttactactcctcagacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaa

SEQ ID NO: 919 - protein, 113 aa, Homo sapiens
DIVMTQSPDSLAVSLGERATINCKSSQSVLYSSNNKNYFAWYQQRPGQPPKLLIYWASTRESGVPDRFSGSGSGTDFTLTISGLQAEDVAVYYCQQHFTTPQTFGQGTKVEIK

SEQ ID NO: 920 - protein, 10 aa, Homo sapiens
FGQGTKVEIK

SEQ ID NO: 921 - protein, 99 aa, Homo sapiens
QLQLQESGPGLVKPSETLSLTCSVSGDSITCSSCYWGWIRQPPGKGLEWIGSMYYSGRTNYNPSLKSRVTISVDTSKSQVSLKLRSVTAADAAVYYCAR

SEQ ID NO: 922 - protein, 25 aa, Homo sapiens
QLQLQESGPGLVKPSETLSLTCSVS

SEQ ID NO: 923 - protein, 10 aa, Homo sapiens
GDSITCSSCY

SEQ ID NO: 924 - protein, 17 aa, Homo sapiens
WGWIRQPPGKGLEWIGS

SEQ ID NO: 925 - protein, 7 aa, Homo sapiens
MYYSGRT

SEQ ID NO: 926 - protein, 38 aa, Homo sapiens
NYNPSLKSRVTISVDTSKSQVSLKLRSVTAADAAVYYC

SEQ ID NO: 927 - protein, 15 aa, Homo sapiens
ARLFGELVGYQAFDV

SEQ ID NO: 928 - DNA, 481 bp, Homo sapiens
cagctgcagctgcaggagtcgggcccaggactggtgaagccttcggagaccctgtccctcacctgcagtgtctctggtgactccattacttgtagtagttgctactggggctggatccgccagcccccagggaaggggctggagtggattggttctatgtattacagtgggagaaccaactacaatccgtccctcaagagtcgagtcaccatatccgtagacacgtccaagagccaggtgtccctgaagttgcgctctgtgaccgccgcagatgcggctgtctattactgtgcgagactattcggggagttggtcggttatcaggcttttgatgtctggggcctagggacaatggtcaccgtctcttcagcgtcgaccaagggcccatcggtcttccccctggcaccctcctccaagagcacctctgggggcacagcggccctgggctgcctggtcaaggactacttccccgaacctgtga

SEQ ID NO: 929 - protein, 123 aa, Homo sapiens
QLQLQESGPGLVKPSETLSLTCSVSGDSITCSSCYWGWIRQPPGKGLEWIGSMYYSGRTNYNPSLKSRVTISVDTSKSQVSLKLRSVTAADAAVYYCARLFGELVGYQAFDVWGLGTMVTVSS

SEQ ID NO: 930 - protein, 11 aa, Homo sapiens
WGLGTMVTVSS

SEQ ID NO: 931 - protein, 98 aa, Homo sapiens
QSVLTQPPSASGTPGQRVTISCSGSSSNIGSNTVNWYQQLPGTAPKLLIYSNIERPSGVPDRFSGSKSGTSASLAISGLQSEDEADYYCAAWDDSLNG

SEQ ID NO: 932 - protein, 25 aa, Homo sapiens
QSVLTQPPSASGTPGQRVTISCSGS

SEQ ID NO: 933 - protein, 8 aa, Homo sapiens
SSNIGSNT

SEQ ID NO: 934 - protein, 17 aa, Homo sapiens
VNWYQQLPGTAPKLLIY

SEQ ID NO: 935 - skipped

SEQ ID NO: 936 - protein, 36 aa, Homo sapiens
ERPSGVPDRFSGSKSGTSASLAISGLQSEDEADYYC

SEQ ID NO: 937 - protein, 11 aa, Homo sapiens
AAWDDSLNGYV

SEQ ID NO: 938 - DNA, 482 bp, Homo sapiens
cagtctgtgctgacgcagccaccctcagcgtctgggacccccgggcagagggtcaccatctcttgttctggaagcagctccaacatcggaagtaatactgtgaactggtaccagcagctcccaggaacggcccccaaactcctcatctatagtaatattgagcggccctcaggggtccctgaccgattctctggctccaagtctggcacctcagcgtccctggccatcagtgggctccagtctgaggatgaggctgattattactgtgcagcctgggatgacagcctgaatggttatgtcttcggaactgggaccaaggtcaccgtcctaggtcagcccaaggccaaccccactgtcactctgttcccgccctcgagtgaggagcttcaagccaacaaggccacactggtgtgtctcataagtgacttctacccgggagccgtgacagtggcctggaaggcagatagcagccccgtcaaggc

SEQ ID NO: 939 - protein, 110 aa, Homo sapiens
QSVLTQPPSASGTPGQRVTISCSGSSSNIGSNTVNWYQQLPGTAPKLLIYSNIERPSGVPDRFSGSKSGTSASLAISGLQSEDEADYYCAAWDDSLNGYVFGTGTKVTVL

SEQ ID NO: 940 - protein, 10 aa, Homo sapiens
FGTGTKVTVL

SEQ ID NO: 941 - protein, 99 aa, Homo sapiens
QVQLQESGPGLVKPSQTLSLTCSVSGDSINSGGFSWTWIRQHPGKGLEWIGSISYNGKIQFNPSLKSRLSMSVDTSKNQFSLKMSSVTGADTAVYFCAR

SEQ ID NO: 942 - protein, 25 aa, Homo sapiens
QVQLQESGPGLVKPSQTLSLTCSVS

SEQ ID NO: 943 - protein, 10 aa, Homo sapiens
GDSINSGGFS

SEQ ID NO: 944 - protein, 17 aa, Homo sapiens
WTWIRQHPGKGLEWIGS

SEQ ID NO: 945 - protein, 7 aa, Homo sapiens
ISYNGKI

SEQ ID NO: 946 - protein, 38 aa, Homo sapiens
QFNPSLKSRLSMSVDTSKNQFSLKMSSVTGADTAVYFC

SEQ ID NO: 947 - protein, 15 aa, Homo sapiens
ARELGDYPYYYAMDV

SEQ ID NO: 948 - DNA, 482 bp, Homo sapiens
caggtgcagctgcaggagtcgggcccaggactggtgaagccttcacagaccctgtccctcacctgctctgtctctggtgactccatcaacagtggtggtttctcttggacctggatccgccagcacccagggaagggcctggagtggattggttccatctcttataatggcaaaattcaattcaacccgtccctcaagagtcggctttccatgtcagtggacacgtcaaagaaccagttctccctgaaaatgagctcagtaactggcgcagacacggccgtttacttttgtgcgagagaacttggcgactatccctattactacgcaatggacgtctggggccaggggaccacggtcaccgtctcctcagcgtcgaccaagggcccatcggtcttccccctggcaccctcctccaagagcacctctgggggcacagcggccctgggctgcctggtcaaggactacttccccgaacctgtgac

SEQ ID NO: 949 - protein, 123 aa, Homo sapiens
QVQLQESGPGLVKPSQTLSLTCSVSGDSINSGGFSWTWIRQHPGKGLEWIGSISYNGKIQFNPSLKSRLSMSVDTSKNQFSLKMSSVTGADTAVYFCARELGDYPYYYAMDVWGQGTTVTVSS

SEQ ID NO: 950 - protein, 11 aa, Homo sapiens
WGQGTTVTVSS

SEQ ID NO: 951 - protein, 95 aa, Homo sapiens
DIQMTQSPSFLSASVGDRVTITCRASQGIASFLAWYQQKPGRAPNLLVYAASSLQTGVPSRFSGGGSGTEFTLTINSLQPEDFATYYCQQVITFP

SEQ ID NO: 952 - protein, 26 aa, Homo sapiens
DIQMTQSPSFLSASVGDRVTITCRAS

SEQ ID NO: 953 - protein, 6 aa, Homo sapiens
QGIASF

SEQ ID NO: 954 - protein, 17 aa, Homo sapiens
LAWYQQKPGRAPNLLVY

SEQ ID NO: 955 - skipped

SEQ ID NO: 956 - protein, 36 aa, Homo sapiens
SLQTGVPSRFSGGGSGTEFTLTINSLQPEDFATYYC

SEQ ID NO: 957 - protein, 9 aa, Homo sapiens
QQVITFPRT

SEQ ID NO: 958 - DNA, 564 bp, Homo sapiens
gacatccagatgacccagtctccatccttcctgtctgcatctgtgggagacagagtcaccatcacttgccgggccagtcagggcattgccagttttttagcctggtatcaacaaaagccagggagagcccctaacctcctggtctatgctgcgtcctctttgcaaactggggtcccatcaaggttcagcggcggtggatctgggacagagttcactctcacaatcaacagcctacagcctgaagattttgccacttattactgtcaacaggtcattactttccctcggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaa

SEQ ID NO: 959 - protein, 107 aa, Homo sapiens
DIQMTQSPSFLSASVGDRVTITCRASQGIASFLAWYQQKPGRAPNLLVYAASSLQTGVPSRFSGGGSGTEFTLTINSLQPEDFATYYCQQVITFPRTFGQGTKVEIK

SEQ ID NO: 960 - protein, 10 aa, Homo sapiens
FGQGTKVEIK

SEQ ID NO: 961 - protein, 99 aa, Homo sapiens
QLQLQESGPGLVKPSETLSLTCAVSGGSMRSSSYYWGWIRQPPGKGLEWIGGMYYSGSTYYSPSLKRRVTISVDTSENHFSLKLTSVTAADTAVYYCAR

SEQ ID NO: 962 - protein, 25 aa, Homo sapiens
QLQLQESGPGLVKPSETLSLTCAVS

SEQ ID NO: 963 - protein, 10 aa, Homo sapiens
GGSMRSSSYY

SEQ ID NO: 964 - protein, 17 aa, Homo sapiens
WGWIRQPPGKGLEWIGG

SEQ ID NO: 965 - protein, 7 aa, Homo sapiens
MYYSGST

SEQ ID NO: 966 - protein, 38 aa, Homo sapiens
YYSPSLKRRVTISVDTSENHFSLKLTSVTAADTAVYYC

SEQ ID NO: 967 - protein, 15 aa, Homo sapiens
ARRWFGELDYYGSDV

SEQ ID NO: 968 - DNA, 479 bp, Homo sapiens
cagctgcagctgcaggagtcgggcccaggactggtgaagccttcggagaccctgtccctcacctgcgctgtctctgggggctccatgaggagtagtagttactactggggctggatccgccagcccccagggaagggactggagtggattgggggtatgtattatagtgggagcacctactacagcccgtccctcaagaggcgagtcaccatatccgtagacacgtccgagaaccacttctccctgaagttgacctctgtgaccgccgcagacacggctgtctattactgtgcgagacgatggttcggggagctagactactacggttcggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgt

SEQ ID NO: 969 - protein, 123 aa, Homo sapiens
QLQLQESGPGLVKPSETLSLTCAVSGGSMRSSSYYWGWIRQPPGKGLEWIGGMYYSGSTYYSPSLKRRVTISVDTSENHFSLKLTSVTAADTAVYYCARRWFGELDYYGSDVWGQGTTVTVSS

SEQ ID NO: 970 - protein, 11 aa, Homo sapiens
WGQGTTVTVSS

SEQ ID NO: 971 - protein, 99 aa, Homo sapiens
  MOD_RES (28)..(28): Any amino acid
  MOD_RES (37)..(37): Any amino acid
  MOD_RES (52)..(52): Any amino acid
  MOD_RES (70)..(70): Any amino acid
  MOD_RES (99)..(99): Any amino acid
QLVLTQSPSASASLGTSVKLTCTLSSGXSSSPIAWHXQQPEKGPRFLMKVNXDGSHYKEDGIPDRFSGSXSGSERYLTISNLQSEDEADYYCQTWGTDX

SEQ ID NO: 972 - protein, 25 aa, Homo sapiens
QLVLTQSPSASASLGTSVKLTCTLS

SEQ ID NO: 973 - protein, 7 aa, Homo sapiens
  MOD_RES (3)..(3): Any amino acid
SGXSSSP

SEQ ID NO: 974 - protein, 17 aa, Homo sapiens
  MOD_RES (5)..(5): Any amino acid
IAWHXQQPEKGPRFLMK

SEQ ID NO: 975 - protein, 7 aa, Homo sapiens
  MOD_RES (3)..(3): Any amino acid
VNXDGSH

SEQ ID NO: 976 - protein, 36 aa, Homo sapiens
  MOD_RES (14)..(14): Any amino acid
YKEDGIPDRFSGSXSGSERYLTISNLQSEDEADYYC

SEQ ID NO: 977 - protein, 9 aa, Homo sapiens
  MOD_RES (7)..(7): Any amino acid
QTWGTDXQV

SEQ ID NO: 978 - DNA, 482 bp, Homo sapiens
  modified_base (82)..(82): a, c, t, g, unknown or other
  misc_feature (82)..(82): a, c, t, g, unknown or other
  modified_base (110)..(110): a, c, t, g, unknown or other
  misc_feature (110)..(110): a, c, t, g, unknown or other
  modified_base (155)..(155): a, c, t, g, unknown or other
  misc_feature (155)..(155): a, c, t, g, unknown or other
  modified_base (208)..(208): a, c, t, g, unknown or other
  misc_feature (208)..(208): a, c, t, g, unknown or other
  modified_base (295)..(295): a, c, t, g, unknown or other
  misc_feature (295)..(295): a, c, t, g, unknown or other
cagcttgtgctgactcaatcgccctctgcctctgcctccctgggaacctcggtcaagctcacctgcactctgagcagcgggnacagcagctcccccatcgcatggcatcngcagcagccggagaagggccctcggttcttgatgaaggttaacantgatggcagtcactacaaagaggacgggatccctgatcgcttctcgggctccnagtctgggtctgagcgctacctcaccatctccaacctccagtccgaggatgaggctgattattactgtcagacctggggcactgacnttcaggtattcggcggagggaccaagctgaccgtcctgggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaa

SEQ ID NO: 979 - protein, 111 aa, Homo sapiens
  MOD_RES (28)..(28): Any amino acid
  MOD_RES (37)..(37): Any amino acid
  MOD_RES (52)..(52): Any amino acid
  MOD_RES (70)..(70): Any amino acid
  MOD_RES (99)..(99): Any amino acid
QLVLTQSPSASASLGTSVKLTCTLSSGXSSSPIAWHXQQPEKGPRFLMKVNXDGSHYKEDGIPDRFSGSXSGSERYLTISNLQSEDEADYYCQTWGTDXQVFGGGTKLTVL

SEQ ID NO: 980 - protein, 10 aa, Homo sapiens
FGGGTKLTVL

SEQ ID NO: 981 - protein, 97 aa, Homo sapiens
QVQLQESRPGLVKPSETLSLSCTVSGGSMRSYYWSWIRQSPGKGLEWIGYVYYSGGTEYNPSLKSRVIISVDTSKNQFSLNLSSVSAADTAVYYCAR

SEQ ID NO: 982 - protein, 25 aa, Homo sapiens
QVQLQESRPGLVKPSETLSLSCTVS

SEQ ID NO: 983 - protein, 8 aa, Homo sapiens
GGSMRSYY

SEQ ID NO: 984 - protein, 17 aa, Homo sapiens
WSWIRQSPGKGLEWIGY

SEQ ID NO: 985 - protein, 7 aa, Homo sapiens
VYYSGGT

SEQ ID NO: 986 - protein, 38 aa, Homo sapiens
EYNPSLKSRVIISVDTSKNQFSLNLSSVSAADTAVYYC

SEQ ID NO: 987 - protein, 19 aa, Homo sapiens
ARGVSALVSVDYYYYYMDV

SEQ ID NO: 988 - DNA, 481 bp, Homo sapiens
caggtgcagctgcaggagtcgcgtccaggactggtgaagccttcggagaccctgtccctcagctgcactgtctctggtggctccatgagaagttactactggagctggatccggcagtccccaggaaaaggactggagtggattggctatgtctattatagtgggggcaccgagtacaacccctccctcaagagtcgagtaatcatatcagtagacacgtccaagaaccagttctccctgaacctgagctctgtgagcgctgcggacacggccgtttattactgtgcgagaggggtatcagctcttgtttccgtggactactactactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaac

SEQ ID NO: 989 - protein, 125 aa, Homo sapiens
QVQLQESRPGLVKPSETLSLSCTVSGGSMRSYYWSWIRQSPGKGLEWIGYVYYSGGTEYNPSLKSRVIISVDTSKNQFSLNLSSVSAADTAVYYCARGVSALVSVDYYYYYMDVWGKGTTVTVSS

SEQ ID NO: 990 - protein, 11 aa, Homo sapiens
WGKGTTVTVSS

SEQ ID NO: 991 - protein, 95 aa, Homo sapiens
SYELTQPPSVSVAPGKTAIITCGGNNIGSKSVQWYQRKPGQAPVLVIYYNRDRPSGIPERFSGSNSGNTATLTISRVEAGDEADYYCQVWDRNID

SEQ ID NO: 992 - protein, 25 aa, Homo sapiens
SYELTQPPSVSVAPGKTAIITCGGN

SEQ ID NO: 993 - protein, 6 aa, Homo sapiens
NIGSKS

SEQ ID NO: 994 - protein, 17 aa, Homo sapiens
VQWYQRKPGQAPVLVIY

SEQ ID NO: 995 - skipped

SEQ ID NO: 996 - protein, 36 aa, Homo sapiens
DRPSGIPERFSGSNSGNTATLTISRVEAGDEADYYC

SEQ ID NO: 997 - protein, 10 aa, Homo sapiens
QVWDRNIDPH

SEQ ID NO: 998 - DNA, 481 bp, Homo sapiens
tcctatgagctgacacagccaccctcagtgtcagtggccccaggaaagacggccataattacctgtgggggaaacaacattggaagtaagagtgtgcagtggtatcagcggaagccaggccaggcccctgtgttggtcatctattataatagggaccggccctcagggatccctgagcgattctctggctccaactctgggaacacggccaccctgaccatcagcagggtcgaggccggggatgaggccgactattactgtcaggtgtgggataggaacattgatccccacttcggaactgggaccgaggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtgg

SEQ ID NO: 999 - protein, 107 aa, Homo sapiens
SYELTQPPSVSVAPGKTAIITCGGNNIGSKSVQWYQRKPGQAPVLVIYYNRDRPSGIPERFSGSNSGNTATLTISRVEAGDEADYYCQVWDRNIDPHFGTGTEVTVL

SEQ ID NO: 1000 - protein, 10 aa, Homo sapiens
FGTGTEVTVL

SEQ ID NO: 1001 - protein, 97 aa, Homo sapiens
QVQLQESGPGLVKPSETLSLTCTVSGGSISTYYWTWIRQSPGKGLEWIGYVYYTGGTEYNSSLKSRVTISVDTSKNQFSLKLNSATAADTAVYYCAR

SEQ ID NO: 1002 - protein, 25 aa, Homo sapiens
QVQLQESGPGLVKPSETLSLTCTVS

SEQ ID NO: 1003 - protein, 8 aa, Homo sapiens
GGSISTYY

SEQ ID NO: 1004 - protein, 17 aa, Homo sapiens
WTWIRQSPGKGLEWIGY

SEQ ID NO: 1005 - protein, 7 aa, Homo sapiens
VYYTGGT

SEQ ID NO: 1006 - protein, 38 aa, Homo sapiens
EYNSSLKSRVTISVDTSKNQFSLKLNSATAADTAVYYC

SEQ ID NO: 1007 - protein, 19 aa, Homo sapiens
ARAVSTLVSVDYYFYYIDV

SEQ ID NO: 1008 - DNA, 482 bp, Homo sapiens
caggtgcagctgcaggagtcgggcccaggactggtgaagccttcggagaccctgtccctcacctgcactgtctctggtggctccatcagtacttactactggacctggatccgacagtccccagggaagggactggagtggattggttatgtctattacactgggggcaccgagtacaactcctccctcaagagtcgagtcaccatttcagtagacacgtccaagaatcagttctccctgaagttgaactccgccaccgctgcggacacggccgtttattactgtgcgagagcagtttcgactcttgtttcagtggactattacttctactacatagacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacc

SEQ ID NO: 1009 - protein, 125 aa, Homo sapiens
QVQLQESGPGLVKPSETLSLTCTVSGGSISTYYWTWIRQSPGKGLEWIGYVYYTGGTEYNSSLKSRVTISVDTSKNQFSLKLNSATAADTAVYYCARAVSTLVSVDYYFYYIDVWGKGTTVTVSS

SEQ ID NO: 1010 - protein, 11 aa, Homo sapiens
WGKGTTVTVSS

SEQ ID NO: 1011 - protein, 95 aa, Homo sapiens
SYELTQPPSVSLAPGKTATITCGGNNIGSKSVHWYQQKPGQAPVLVIYHNNNRPTGIPERFSGSNSGNTATLTISRAAAGDEAEYFCQVWDRNND

SEQ ID NO: 1012 - protein, 25 aa, Homo sapiens
SYELTQPPSVSLAPGKTATITCGGN

SEQ ID NO: 1013 - protein, 6 aa, Homo sapiens
NIGSKS

SEQ ID NO: 1014 - protein, 17 aa, Homo sapiens
VHWYQQKPGQAPVLVIY

SEQ ID NO: 1015 - skipped

SEQ ID NO: 1016 - protein, 36 aa, Homo sapiens
NRPTGIPERFSGSNSGNTATLTISRAAAGDEAEYFC

SEQ ID NO: 1017 - protein, 10 aa, Homo sapiens
QVWDRNNDPL

SEQ ID NO: 1018 - DNA, 482 bp, Homo sapiens
tcctatgagctgacacagccaccctcagtgtcactggccccaggaaagacggccacgattacctgtgggggaaataacattggaagtaaaagtgtgcactggtatcagcagaagccaggccaggcccctgtcctggtcatctatcataataataatcggcccacagggatccctgagcgattctctggctccaactctgggaacacggccaccctgaccatcagcagggccgcagccggggatgaggccgagtacttctgtcaggtttgggataggaataatgatcccctcttcggaactgggaccaaggtcaccgtcctaagtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtgga

SEQ ID NO: 1019 - protein, 107 aa, Homo sapiens
SYELTQPPSVSLAPGKTATITCGGNNIGSKSVHWYQQKPGQAPVLVIYHNNNRPTGIPERFSGSNSGNTATLTISRAAAGDEAEYFCQVWDRNNDPLFGTGTKVTVL

SEQ ID NO: 1020 - protein, 10 aa, Homo sapiens
FGTGTKVTVL

SEQ ID NO: 1021 - protein, 97 aa, Homo sapiens
QVQLQESGPGLVKPSETLSLTCTVSGGSIRSYYWSWIRQPPGKGLEWIGYVYYTGGTEYNPSLKSRVIISVDTSKNQFSLNLSSVTAADTAVYYCAR

SEQ ID NO: 1022 - protein, 25 aa, Homo sapiens
QVQLQESGPGLVKPSETLSLTCTVS

SEQ ID NO: 1023 - protein, 8 aa, Homo sapiens
GGSIRSYY

SEQ ID NO: 1024 - protein, 17 aa, Homo sapiens
WSWIRQPPGKGLEWIGY

SEQ ID NO: 1025 - protein, 7 aa, Homo sapiens
VYYTGGT

SEQ ID NO: 1026 - protein, 38 aa, Homo sapiens
EYNPSLKSRVIISVDTSKNQFSLNLSSVTAADTAVYYC

SEQ ID NO: 1027 - protein, 19 aa, Homo sapiens
ARGVSALVSVDYYYYYMDV

SEQ ID NO: 1028 - DNA, 481 bp, Homo sapiens
caggtgcagctgcaggagtcgggcccaggactggtgaagccttcggagaccctgtccctcacctgcactgtctctggtggctccatcagaagttactactggagttggatccggcagcccccaggaaaaggactggagtggattggctatgtctattatactgggggcaccgagtacaatccctccctcaagagtcgagtaatcatatcagtagacacgtccaagaaccagttctccctgaacctgagctctgtgaccgctgcggacacggccgtttattactgtgcgagaggggtatcagctcttgtttccgtggactactactactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaac

SEQ ID NO: 1029 - protein, 125 aa, Homo sapiens
QVQLQESGPGLVKPSETLSLTCTVSGGSIRSYYWSWIRQPPGKGLEWIGYVYYTGGTEYNPSLKSRVIISVDTSKNQFSLNLSSVTAADTAVYYCARGVSALVSVDYYYYYMDVWGKGTTVTVSS

SEQ ID NO: 1030 - protein, 11 aa, Homo sapiens
WGKGTTVTVSS

SEQ ID NO: 1031 - protein, 95 aa, Homo sapiens
SYELTQPPSVSVAPGKTAIITCGGNNIGSKSVQWYQQKPGQAPVLVIYYNRDRPSGIPERFSGSNSGNTATLTISRVEAGDEADYYCQVWDRNID

SEQ ID NO: 1032 - protein, 25 aa, Homo sapiens
SYELTQPPSVSVAPGKTAIITCGGN

SEQ ID NO: 1033 - protein, 6 aa, Homo sapiens
NIGSKS

SEQ ID NO: 1034 - protein, 17 aa, Homo sapiens
VQWYQQKPGQAPVLVIY

SEQ ID NO: 1035 - skipped

SEQ ID NO: 1036 - protein, 36 aa, Homo sapiens; identical to SEQ ID NO: 996

SEQ ID NO: 1037 - protein, 10 aa, Homo sapiens
QVWDRNIDPH

SEQ ID NO: 1038 - DNA, 481 bp, Homo sapiens
tcctatgagctgactcagccaccctcagtgtcagtggccccaggaaagacggccataattacctgtgggggaaacaacattggaagtaagagtgtgcagtggtatcagcagaagccaggccaggcccctgtgttggtcatctattataatagggaccggccctcagggatccctgagcgattctctggctccaactctgggaacacggccaccctgaccatcagcagggtcgaggccggggatgaggccgactattactgtcaggtgtgggataggaatattgatccccacttcggaactgggaccgaggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtgg

SEQ ID NO: 1039 - protein, 107 aa, Homo sapiens
SYELTQPPSVSVAPGKTAIITCGGNNIGSKSVQWYQQKPGQAPVLVIYYNRDRPSGIPERFSGSNSGNTATLTISRVEAGDEADYYCQVWDRNIDPHFGTGTEVTVL

SEQ ID NO: 1040 - protein, 10 aa, Homo sapiens
FGTGTEVTVL

SEQ ID NO: 1041 - protein, 94 aa, Homo sapiens
QVQLQESGPGLLKPSETLSLTCTVSGGSISKYYWTWIRQPPGKTLEWIGYVHYAFYIGATNYNPSLKSRVTISVDTAKNQVSLRLTSVTAADTA

SEQ ID NO: 1042 - protein, 25 aa, Homo sapiens
QVQLQESGPGLLKPSETLSLTCTVS

SEQ ID NO: 1043 - protein, 8 aa, Homo sapiens
GGSISKYY

SEQ ID NO: 1044 - protein, 17 aa, Homo sapiens
WTWIRQPPGKTLEWIGY

SEQ ID NO: 1045 - protein, 7 aa, Homo sapiens
VHYAFYI

SEQ ID NO: 1046 - protein, 38 aa, Homo sapiens
GATNYNPSLKSRVTISVDTAKNQVSLRLTSVTAADTAV

SEQ ID NO: 1047 - protein, 21 aa, Homo sapiens
YYCVRADGDSEGFGYHYGMDV

SEQ ID NO: 1048 - DNA, 481 bp, Homo sapiens
caggtgcagctgcaggagtcgggcccaggactgctgaagccttcggagaccctgtccctcacctgcactgtctctggtggctccatcagtaaatattactggacctggatccggcagcccccagggaagacactggagtggattggatatgtccattatgccttttatattggggccaccaattataacccctccctcaagagtcgagtcaccatatcagtagacacggccaagaaccaggtctcccttaggttgacctctgtgaccgctgcggacacggccgtttattactgtgtgagagcagacggtgactccgaggggttcgggtaccactacggaatggacgtctggggccgggggaccacggtcaccgtctcctcagcgtcgaccaagggcccatcggtcttccccctggcaccctcctccaagagcacctctgggggcacagcggccctgggctgcctggtcaaggactacttcc

SEQ ID NO: 1049 - protein, 127 aa, Homo sapiens
QVQLQESGPGLLKPSETLSLTCTVSGGSISKYYWTWIRQPPGKTLEWIGYVHYAFYIGATNYNPSLKSRVTISVDTAKNQVSLRLTSVTAADTAVYYCVRADGDSEGFGYHYGMDVWGRGTTVTVSS

SEQ ID NO: 1050 - protein, 11 aa, Homo sapiens
WGRGTTVTVSS

SEQ ID NO: 1051 - protein, 95 aa, Homo sapiens
DIQMTQSPSSLSASVGDRVTITCRASQGIGNDLAWYQQKLGTAPKRLIYDASSLQSGVPSRFSGSGSGTEFTLTISSLQPEDFATYYCLQHNDYP

SEQ ID NO: 1052 - protein, 26 aa, Homo sapiens [sequence omitted]

SEQ ID NO: 1053 - protein, 6 aa, Homo sapiens
QGIGND

SEQ ID NO: 1054 - protein, 17 aa, Homo sapiens
LAWYQQKLGTAPKRLIY

SEQ ID NO: 1055 - skipped

SEQ ID NO: 1056 - protein, 36 aa, Homo sapiens
SLQSGVPSRFSGSGSGTEFTLTISSLQPEDFATYYC

SEQ ID NO: 1057 - protein, 9 aa, Homo sapiens
LQHNDYPLT

SEQ ID NO: 1058 - DNA, 484 bp, Homo sapiens
gacatccagatgacccagtctccatcctccctgtctgcatctgtaggagacagagtcaccatcacttgccgggcaagtcagggcattggaaatgacttagcctggtatcaacagaaactagggacagcccctaagcgcctgatttatgatgcatccagtttgcaaagtggggtcccatcgagattcagcggcagtggatctgggacagaattcactctcacaatcagcagcctgcagcctgaagattttgcaacttattactgcctacaacataatgattaccctctgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggaga

SEQ ID NO: 1059 - protein, 107 aa, Homo sapiens
DIQMTQSPSSLSASVGDRVTITCRASQGIGNDLAWYQQKLGTAPKRLIYDASSLQSGVPSRFSGSGSGTEFTLTISSLQPEDFATYYCLQHNDYPLTFGQGTKVEIK

SEQ ID NO: 1060 - protein, 10 aa, Homo sapiens
FGQGTKVEIK

SEQ ID NO: 1061 - protein, 97 aa, Homo sapiens
QVQLVQSGAEVKKPGSSVKVSCKASGVIFSNYAIGWVRQAPGQGLEWVGGILPIFGTANYAQRFQGRVTITADESTSTTYMELSSLRSDDTAVYYCA

SEQ ID NO: 1062 - protein, 25 aa, Homo sapiens [sequence omitted]

SEQ ID NO: 1063 - protein, 8 aa, Homo sapiens
GVIFSNYA

SEQ ID NO: 1064 - protein, 17 aa, Homo sapiens
IGWVRQAPGQGLEWVGG

SEQ ID NO: 1065 - protein, 8 aa, Homo sapiens
ILPIFGTA

SEQ ID NO: 1066 - protein, 38 aa, Homo sapiens
NYAQRFQGRVTITADESTSTTYMELSSLRSDDTAVYYC

SEQ ID NO: 1067 - protein, 13 aa, Homo sapiens
ARAARLYQQAYDI

SEQ ID NO: 1068 - DNA, 479 bp, Homo sapiens
caggtgcagctggtgcagtctggggctgaggtgaagaagcctgggtcctcggtgaaggtctcctgcaaggcctctggagtcatcttcagcaactatgctatcggctgggtgcgacaggcccctggacaagggcttgaatgggtgggagggatcctccctatttttggtacggcaaactacgcacagaggtttcagggcagggtcacgattaccgcggacgaatccacgagcacaacctacatggagctgagcagcctgagatctgacgacacggccgtatattactgtgcgagggcggcccgactttatcaacaggcttatgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctc

SEQ ID NO: 1069 - protein, 120 aa, Homo sapiens
QVQLVQSGAEVKKPGSSVKVSCKASGVIFSNYAIGWVRQAPGQGLEWVGGILPIFGTANYAQRFQGRVTITADESTSTTYMELSSLRSDDTAVYYCARAARLYQQAYDIWGQGTMVTVSS

SEQ ID NO: 1070 - protein, 11 aa, Homo sapiens
WGQGTMVTVSS

SEQ ID NO: 1071 - protein, 95 aa, Homo sapiens
AIQLTQSPSSLSASVGDRVTITCRASQGISSALAWYQQKPGEPPKLLISDASSLQSGVPSRFSGSGSGTDFTLTISSLQPEDFATYYCQQFHSYP

SEQ ID NO: 1072 - protein, 26 aa, Homo sapiens
AIQLTQSPSSLSASVGDRVTITCRAS

SEQ ID NO: 1073 - protein, 6 aa, Homo sapiens
QGISSA

SEQ ID NO: 1074 - protein, 17 aa, Homo sapiens
LAWYQQKPGEPPKLLIS

SEQ ID NO: 1075 - skipped

SEQ ID NO: 1076 - protein, 36 aa, Homo sapiens
SLQSGVPSRFSGSGSGTDFTLTISSLQPEDFATYYC

SEQ ID NO: 1077 - protein, 10 aa, Homo sapiens
QQFHSYPLFT

SEQ ID NO: 1078 - DNA, 565 bp, Homo sapiens
gccatccagttgacccagtctccatcctccctgtctgcatctgtaggagacagagtcaccatcacttgccgggcaagtcagggcattagcagtgctttagcctggtatcagcagaaaccaggtgaacctcctaagctcctaatctctgatgcctccagtttgcaaagtggggtcccatcaaggttcagcggcagtggatctgggacagatttcactctcaccatcagcagcctgcagcctgaagattttgcaacttattactgtcaacagtttcacagttaccctctgttcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgaga

SEQ ID NO: 1079 - protein, 108 aa, Homo sapiens
AIQLTQSPSSLSASVGDRVTITCRASQGISSALAWYQQKPGEPPKLLISDASSLQSGVPSRFSGSGSGTDFTLTISSLQPEDFATYYCQQFHSYPLFTFGPGTKVDIK

SEQ ID NO: 1080 - protein, 10 aa, Homo sapiens
FGPGTKVDIK

SEQ ID NO: 1081 - protein, 99 aa, Homo sapiens
QLQLQESGPGLVKPSETLSLICSVSGDSMSCSSCYWGWIRQPPGKGLEYIGSSHYTGRTSHNPSLKSRVTISVDTSKRQLSLRLSSVTAADTAVYYCAR

SEQ ID NO: 1082 - protein, 25 aa, Homo sapiens
QLQLQESGPGLVKPSETLSLICSVS

SEQ ID NO: 1083 - protein, 10 aa, Homo sapiens
GDSMSCSSCY

SEQ ID NO: 1084 - protein, 17 aa, Homo sapiens
WGWIRQPPGKGLEYIGS

SEQ ID NO: 1085 - protein, 7 aa, Homo sapiens
SHYTGRT

SEQ ID NO: 1086 - protein, 38 aa, Homo sapiens
SHNPSLKSRVTISVDTSKRQLSLRLSSVTAADTAVYYC

SEQ ID NO: 1087 - protein, 15 aa, Homo sapiens
ARLFGELVGYQAFDF

SEQ ID NO: 1088 - DNA, 481 bp, Homo sapiens
cagctgcagctgcaggagtcgggccccggactggtaaagccttcggagaccctgtccctcatttgcagtgtctctggtgactccatgagctgtagtagttgctactggggctggatccgccagcccccagggaaggggctggaatacattgggagttcccattatactgggcgcacctcccacaacccgtctctcaaaagtcgagtcaccatttccgttgacacgtccaagaggcagctctccctgaggctgagctctgtgaccgccgcagatacggctgtatattactgtgcgagactgttcggggaattagttggttatcaggcttttgatttctggggtctagggacaatggtcaccgtctcttcagcgtcgaccaagggcccatcggtcttccccctggcaccctcctccaagagcacctctgggggcacagcggccctgggctgcctggtcaaggactacttccccgaacctgtga

SEQ ID NO: 1089 - protein, 123 aa, Homo sapiens
QLQLQESGPGLVKPSETLSLICSVSGDSMSCSSCYWGWIRQPPGKGLEYIGSSHYTGRTSHNPSLKSRVTISVDTSKRQLSLRLSSVTAADTAVYYCARLFGELVGYQAFDFWGLGTMVTVSS

SEQ ID NO: 1090 - protein, 11 aa, Homo sapiens
WGLGTMVTVSS

SEQ ID NO: 1091 - protein, 98 aa, Homo sapiens
QSVLTQPPSASGTPGQRVTISCSGSSSNIGSNSVNWYQQLPGTAPKLLIFSNNERPSGVPDRFSGSKSGTSASLAISGLQSEDEADYYCAAWDDSLDG

SEQ ID NO: 1092 - protein, 25 aa, Homo sapiens
QSVLTQPPSASGTPGQRVTISCSGS

SEQ ID NO: 1093 - protein, 8 aa, Homo sapiens
SSNIGSNS

SEQ ID NO: 1094 - protein, 17 aa, Homo sapiens
VNWYQQLPGTAPKLLIF

SEQ ID NO: 1095 - skipped

SEQ ID NO: 1096 - protein, 36 aa, Homo sapiens; identical to SEQ ID NO: 936

SEQ ID NO: 1097 - protein, 11 aa, Homo sapiens
AAWDDSLDGYV

SEQ ID NO: 1098 - DNA, 481 bp, Homo sapiens
cagtctgtgctgactcagccaccctcagcgtctgggacccccgggcagagggtcaccatctcttgttctggaagcagctccaacatcggaagtaattctgttaactggtaccagcaactcccaggaacggcccccaaactcctcatctttagtaataatgagcggccctcaggggtccctgaccgattctctggctccaagtctggcacctcagcctccctggccatcagtggactccagtctgaggatgaggctgattactactgtgcagcatgggatgacagcctggatggttatgtcttcggaagtgggaccaaggtcaccgtcctaggtcagcccaaggccaaccccactgtcactctgttcccgccctcgagtgaggagcttcaagccaacaaggccacactggtgtgtctcataagtgacttctacccgggagccgtgacagtggcctggaaggcagatagcagccccgtcaagg

SEQ ID NO: 1099 - protein, 110 aa, Homo sapiens
QSVLTQPPSASGTPGQRVTISCSGSSSNIGSNSVNWYQQLPGTAPKLLIFSNNERPSGVPDRFSGSKSGTSASLAISGLQSEDEADYYCAAWDDSLDGYVFGSGTKVTVL

SEQ ID NO: 1100 - protein, 10 aa, Homo sapiens
FGSGTKVTVL

SEQ ID NO: 1101 - protein, 97 aa, Homo sapiens
QVQLVESGGGVVQPGRSLRLSCAASGFTFSSYGIHWARRVPGKGLEWVALISYDGYNKYYADSVKGRFIISRDNSRNRVDLQMNSLRAEDAAVYYCA

SEQ ID NO: 1102 - protein, 25 aa, Homo sapiens
QVQLVESGGGVVQPGRSLRLSCAAS

SEQ ID NO: 1103 - protein, 8 aa, Homo sapiens
GFTFSSYG

SEQ ID NO: 1104 - protein, 17 aa, Homo sapiens
IHWARRVPGKGLEWVAL

SEQ ID NO: 1105 - protein, 8 aa, Homo sapiens
ISYDGYNK

SEQ ID NO: 1106 - protein, 38 aa, Homo sapiens
YYADSVKGRFIISRDNSRNRVDLQMNSLRAEDAAVYYC

SEQ ID NO: 1107 - protein, 18 aa, Homo sapiens
AKIFSWQQLDYYYYAMDV

SEQ ID NO: 1108 - DNA, 480 bp, Homo sapiens
caggtgcagctggtggagtctgggggaggcgtggtccagcctgggaggtccctgagactctcctgtgcagcctctggattcaccttcagttcctatggcatccactgggcccgccgggttccaggcaagggactggagtgggtggcacttatatcatatgatggatataataaatattatgcagactccgtgaagggccgattcatcatctccagagacaactccaggaacagagttgatctgcaaatgaacagcctgagagctgaggacgcggctgtgtattactgtgcgaaaatcttttcttggcagcagctcgactactattattacgctatggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaa

SEQ ID NO: 1109 - protein, 125 aa, Homo sapiens
QVQLVESGGGVVQPGRSLRLSCAASGFTFSSYGIHWARRVPGKGLEWVALISYDGYNKYYADSVKGRFIISRDNSRNRVDLQMNSLRAEDAAVYYCAKIFSWQQLDYYYYAMDVWGQGTTVTVSS

SEQ ID NO: 1110 - protein, 11 aa, Homo sapiens
WGQGTTVTVSS

SEQ ID NO: 1111 - protein, 97 aa, Homo sapiens
QSVLTQPPSASGTPGQTVPISCSGSSSNVGSHPVHWYQQLPGTAPKLLIYSDRQRPSEVPGRFSGSKSGTSASLRISGLQSDDEGDYYCAAWDDSLD

SEQ ID NO: 1112 - protein, 25 aa, Homo sapiens
QSVLTQPPSASGTPGQTVPISCSGS

SEQ ID NO: 1113 - protein, 8 aa, Homo sapiens
SSNVGSHP

SEQ ID NO: 1114 - protein, 17 aa, Homo sapiens
VHWYQQLPGTAPKLLIY

SEQ ID NO: 1115 - skipped

SEQ ID NO: 1116 - protein, 36 aa, Homo sapiens
QRPSEVPGRFSGSKSGTSASLRISGLQSDDEGDYYC

SEQ ID NO: 1117 - protein, 11 aa, Homo sapiens
AAWDDSLDGVV

SEQ ID NO: 1118 - DNA, 480 bp, Homo sapiens
cagtctgtgctgacgcagccaccctcggcgtctgggacccccggccagacggtccccatctcttgttctggaagcagttccaacgtcggaagtcatcctgtacactggtaccagcaactcccaggaacggcccccaaactcctcatttatagtgatcgtcagcgcccctcagaggtccctggccgattctctggctccaagtctggcacctcagcctccctgagaatcagtgggctccagtctgacgatgagggtgattattattgtgcagcatgggacgacagcctggatggagtggtcttcggcggggggaccaaactgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaag

SEQ ID NO: 1119 - protein, 110 aa, Homo sapiens
QSVLTQPPSASGTPGQTVPISCSGSSSNVGSHPVHWYQQLPGTAPKLLIYSDRQRPSEVPGRFSGSKSGTSASLRISGLQSDDEGDYYCAAWDDSLDGVVFGGGTKLTVL

SEQ ID NO: 1120 - protein, 10 aa, Homo sapiens
FGGGTKLTVL

SEQ ID NO: 1121 - protein, 98 aa, Homo sapiens
EVQLVESGGDLVQPGGSLRLSCAGSGFTFSSSWMHWVRQAPGKGLVWVSRINSGGNFKKYADSVRGRFTISRDNTRNTLYLHMSSLRHEDTALYYCAR

SEQ ID NO: 1122 - protein, 25 aa, Homo sapiens
EVQLVESGGDLVQPGGSLRLSCAGS

SEQ ID NO: 1123 - protein, 8 aa, Homo sapiens
GFTFSSSW

SEQ ID NO: 1124 - protein, 17 aa, Homo sapiens
MHWVRQAPGKGLVWVSR

SEQ ID NO: 1125 - protein, 8 aa, Homo sapiens
INSGGNFK

SEQ ID NO: 1126 - protein, 38 aa, Homo sapiens
KYADSVRGRFTISRDNTRNTLYLHMSSLRHEDTALYYC

SEQ ID NO: 1127 - protein, 16 aa, Homo sapiens
ARDHDYGDYRGNAYDI

SEQ ID NO: 1128 - DNA, 480 bp, Homo sapiens
gaggtgcagctggtggagtcggggggagacttagttcagccgggggggtccctgagactctcctgtgcaggctctggattcaccttcagtagttcctggatgcactgggtccgccaagctccagggaaggggctggtgtgggtctcacgtattaatagtggtgggaatttcaaaaaatacgcggactccgtgaggggccgattcaccatctccagagacaacaccaggaacaccctatatctgcatatgagcagtctgagacacgaggacacggctctttattactgtgcaagagatcatgactacggtgactacagagggaacgcgtatgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtg

SEQ ID NO: 1129 - protein, 123 aa, Homo sapiens
EVQLVESGGDLVQPGGSLRLSCAGSGFTFSSSWMHWVRQAPGKGLVWVSRINSGGNFKKYADSVRGRFTISRDNTRNTLYLHMSSLRHEDTALYYCARDHDYGDYRGNAYDIWGQGTMVTVSS

SEQ ID NO: 1130 - protein, 11 aa, Homo sapiens
WGQGTMVTVSS

SEQ ID NO: 1131 - protein, 90 aa, Homo sapiens
DIQMTQSPSSLSASVGDRVTITCQASQDISNYFNWYQQKPGKAPKLLIFDTSKLETGVPSRFSGRQSGTDYTFTISSLQPEDIATYFCQQ

SEQ ID NO: 1132 - protein, 26 aa, Homo sapiens
DIQMTQSPSSLSASVGDRVTITCQAS

SEQ ID NO: 1133 - protein, 6 aa, Homo sapiens
QDISNY

SEQ ID NO: 1134 - protein, 17 aa, Homo sapiens
FNWYQQKPGKAPKLLIF

SEQ ID NO: 1135 - skipped

SEQ ID NO: 1136 - protein, 36 aa, Homo sapiens
KLETGVPSRFSGRQSGTDYTFTISSLQPEDIATYFC

SEQ ID NO: 1137 - protein, 5 aa, Homo sapiens
QQLDS

SEQ ID NO: 1138 - DNA, 484 bp, Homo sapiens
gacatccagatgacccagtctccatcctccctgtctgcatctgtgggagacagagtcaccatcacttgccaggcgagtcaggacattagcaactatttcaattggtatcagcagaaaccagggaaagcccctaagctcctaatcttcgatacatccaagttggaaacaggggtcccatcaaggttcagtggaagacaatctgggacagattatactttcaccatcagcagcctgcagcctgaagatattgcaacatatttctgtcagcagcttgatagtttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagc

SEQ ID NO: 1139 - protein, 103 aa, Homo sapiens
DIQMTQSPSSLSASVGDRVTITCQASQDISNYFNWYQQKPGKAPKLLIFDTSKLETGVPSRFSGRQSGTDYTFTISSLQPEDIATYFCQQLDSFGGGTKVEIK

SEQ ID NO: 1140 - protein, 10 aa, Homo sapiens
FGGGTKVEIK

SEQ ID NO: 1141 - protein, 99 aa, Homo sapiens
QLQLQESGPGLVKPSETLSLTCTVSGGSISNNIYYWTWIRQPPGKGLEWIGSIYYSGNIYYNPSLKSRVTISVDTSKNQFSLKLRSVTAADTAVYYCAR

SEQ ID NO: 1142 - protein, 25 aa, Homo sapiens
QLQLQESGPGLVKPSETLSLTCTVS

SEQ ID NO: 1143 - protein, 10 aa, Homo sapiens
GGSISNNIYY

SEQ ID NO: 1144 - protein, 17 aa, Homo sapiens
WTWIRQPPGKGLEWIGS

SEQ ID NO: 1145 - protein, 7 aa, Homo sapiens
IYYSGNI

SEQ ID NO: 1146 - protein, 38 aa, Homo sapiens
YYNPSLKSRVTISVDTSKNQFSLKLRSVTAADTAVYYC

SEQ ID NO: 1147 - protein, 17 aa, Homo sapiens
ARHRVGTGPEVGDWFDP

SEQ ID NO: 1148 - DNA, 498 bp, Homo sapiens
cagctgcagctgcaggagtcgggcccaggactggtgaagccttcggagaccctgtccctcacctgcactgtctctggtggctccatcagcaataatatttactactggacctggatccgccagcccccagggaaggggctggagtggattgggagtatctattatagtgggaacatctactacaacccgtccctcaagagtcgagtcaccatatccgtagacacgtccaagaaccaattctccctgaagctgaggtctgtgaccgccgcagacacggctgtgtattactgtgcgagacatagggtgggcactggccccgaagttggggactggttcgacccctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtgg

SEQ ID NO: 1149 - protein, 125 aa, Homo sapiens
QLQLQESGPGLVKPSETLSLTCTVSGGSISNNIYYWTWIRQPPGKGLEWIGSIYYSGNIYYNPSLKSRVTISVDTSKNQFSLKLRSVTAADTAVYYCARHRVGTGPEVGDWFDPWGQGTLVTVSS

SEQ ID NO: 1150 - protein, 11 aa, Homo sapiens
WGQGTLVTVSS

SEQ ID NO: 1151 - protein, 95 aa, Homo sapiens
EIVMTQSPATLSVSPGERATLSCRASQSVSSNLAWYQQKPGQAPRLLIYDASTRATGIPARFSGSGSGTEFTLTISSLQSEDFAVYYCQQYNSWP

SEQ ID NO: 1152 - protein, 26 aa, Homo sapiens
EIVMTQSPATLSVSPGERATLSCRAS

SEQ ID NO: 1153 - protein, 6 aa, Homo sapiens
QSVSSN

SEQ ID NO: 1154 - protein, 17 aa, Homo sapiens
LAWYQQKPGQAPRLLIY

SEQ ID NO: 1155 - skipped

SEQ ID NO: 1156 - protein, 36 aa, Homo sapiens
TRATGIPARFSGSGSGTEFTLTISSLQSEDFAVYYC

SEQ ID NO: 1157 - protein, 11 aa, Homo sapiens
QQYNSWPPMYT

SEQ ID NO: 1158 - DNA, 482 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatgatgcatccaccagggccactggtatcccggccaggttcagtggcagtgggtctgggacagagttcactctcaccatcagcagcctgcagtctgaagattttgcagtttattactgtcagcagtataatagctggcctcccatgtacacttttggccaggggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactc

SEQ ID NO: 1159 - protein, 109 aa, Homo sapiens
EIVMTQSPATLSVSPGERATLSCRASQSVSSNLAWYQQKPGQAPRLLIYDASTRATGIPARFSGSGSGTEFTLTISSLQSEDFAVYYCQQYNSWPPMYTFGQGTKVEIK

SEQ ID NO: 1160 - protein, 10 aa, Homo sapiens
FGQGTKVEIK

SEQ ID NO: 1161 - protein, 98 aa, Homo sapiens
EVQLLESGGGLVQPGGSLRLSCAASGFTFSDYAMSWVRQAPGKGLEWVSGISGRGDSTYYADSVKGRFTISRDNSQNTLYLQMISLRAEDTAEYYCAK

SEQ ID NO: 1162 - protein, 25 aa, Homo sapiens
EVQLLESGGGLVQPGGSLRLSCAAS

SEQ ID NO: 1163 - protein, 8 aa, Homo sapiens
GFTFSDYA

SEQ ID NO: 1164 - protein, 17 aa, Homo sapiens
MSWVRQAPGKGLEWVSG

SEQ ID NO: 1165 - protein, 8 aa, Homo sapiens
ISGRGDST

SEQ ID NO: 1166 - protein, 38 aa, Homo sapiens
YYADSVKGRFTISRDNSQNTLYLQMISLRAEDTAEYYC

SEQ ID NO: 1167 - protein, 6 aa, Homo sapiens
AKDHRG

SEQ ID NO: 1168 - DNA, 415 bp, Homo sapiens
gaggtgcagctgttggagtctgggggaggcttggtacagcctggggggtccctgagactctcctgtgcagcctctggattcacctttagtgactatgccatgagctgggtccgccaggctccagggaaggggctggagtgggtctcaggtattagtggtcgtggtgatagcacatactatgcagactccgtgaagggccggttcaccatctccagagacaattcccagaacacgctgtatctgcaaatgatcagcctgagagccgaggacacggccgaatattactgtgcgaaagatcataggggctggggccagggaaccctggtcaccgtctcctcagcctccaccaagggcccatcggtcttccccctggcaccctcctccaagagcacctctgggggcacagcggccctgg

SEQ ID NO: 1169 - protein, 113 aa, Homo sapiens
EVQLLESGGGLVQPGGSLRLSCAASGFTFSDYAMSWVRQAPGKGLEWVSGISGRGDSTYYADSVKGRFTISRDNSQNTLYLQMISLRAEDTAEYYCAKDHRGWGQGTLVTVSS

SEQ ID NO: 1170 - protein, 11 aa, Homo sapiens
WGQGTLVTVSS

SEQ ID NO: 1171 - protein, 95 aa, Homo sapiens
DIQMTQSPSSLSASVGDRVTITCQASQDISNYLNWYQQKSGKAPKLLIYDASNLDTGVPSRFSGSGSGTDFTFTISSLQPEDFATYYCQQFDKFP

SEQ ID NO: 1172 - protein, 26 aa, Homo sapiens
DIQMTQSPSSLSASVGDRVTITCQAS

SEQ ID NO: 1173 - protein, 6 aa, Homo sapiens
QDISNY

SEQ ID NO: 1174 - protein, 17 aa, Homo sapiens
LNWYQQKSGKAPKLLIY

SEQ ID NO: 1175 - skipped

SEQ ID NO: 1176 - protein, 36 aa, Homo sapiens
NLDTGVPSRFSGSGSGTDFTFTISSLQPEDFATYYC

SEQ ID NO: 1177 - protein, 9 aa, Homo sapiens
QQFDKFPWT

SEQ ID NO: 1178 - DNA, 415 bp, Homo sapiens
gacatccagatgacccagtctccatcctccctgtctgcatctgtaggagacagagtcaccatcacttgccaggcgagtcaggacattagcaactatttaaattggtatcagcagaaatcagggaaagcccctaagctcctgatctacgatgcatccaatttggatacaggggtcccatcaaggttcagtggaagtggatctgggacagattttactttcaccatcagcagcctgcagcctgaagattttgcaacatattactgtcaacagtttgataaattcccttggacgttcggccaagggaccaaggtggaaatcaaacgaactgtggctgcaccatctgtcttcatcttcccgccatctgatgagcagttgaaatctggaactgcctctgttgtgtgcctgctgaataact

SEQ ID NO: 1179 - protein, 107 aa, Homo sapiens
DIQMTQSPSSLSASVGDRVTITCQASQDISNYLNWYQQKSGKAPKLLIYDASNLDTGVPSRFSGSGSGTDFTFTISSLQPEDFATYYCQQFDKFPWTFGQGTKVEIK

SEQ ID NO: 1180 - protein, 10 aa, Homo sapiens
FGQGTKVEIK

SEQ ID NO: 1181 - protein, 99 aa, Homo sapiens
QLQLQESGPGLVKPSETLSLTCSVSGGSISSSTYYWGWIRQPPGKGLEWIGSLYYSGSTDFNPSLKSRVTISVDTSNNRVSLKLRSVTAADTAVYYCAR

SEQ ID NO: 1182 - protein, 25 aa, Homo sapiens
QLQLQESGPGLVKPSETLSLTCSVS

SEQ ID NO: 1183 - protein, 10 aa, Homo sapiens
GGSISSSTYY

SEQ ID NO: 1184 - protein, 17 aa, Homo sapiens
WGWIRQPPGKGLEWIGS

SEQ ID NO: 1185 - protein, 7 aa, Homo sapiens
LYYSGST

SEQ ID NO: 1186 - protein, 38 aa, Homo sapiens
DFNPSLKSRVTISVDTSNNRVSLKLRSVTAADTAVYYC

SEQ ID NO: 1187 - protein, 18 aa, Homo sapiens
ARHAKAPDSFGGAEYFDY

SEQ ID NO: 1188 - DNA, 415 bp, Homo sapiens
cagctgcagctgcaggagtcgggcccaggactggtgaagccttcggagaccctgtccctcacctgctctgtctctggtggctccatcagcagcagtacttactactggggctggatccgccagcccccagggaaggggctggagtggattgggagtctctactatagtgggagcaccgacttcaacccgtccctcaagagtcgagtcaccatatccgtagacacgtccaacaaccgggtctccctgaagctgaggtctgtgaccgccgcagatacggctgtgtattactgtgcgagacacgcgaaagcacccgattcgtttgggggagctgagtactttgactactggggccagggaaccctggtcatcgtctcctcagcctccaccaagggcccatcggtcttccccctggcac

SEQ ID NO: 1189 - protein, 126 aa, Homo sapiens
QLQLQESGPGLVKPSETLSLTCSVSGGSISSSTYYWGWIRQPPGKGLEWIGSLYYSGSTDFNPSLKSRVTISVDTSNNRVSLKLRSVTAADTAVYYCARHAKAPDSFGGAEYFDYWGQGTLVIVSS

SEQ ID NO: 1190 - protein, 11 aa, Homo sapiens
WGQGTLVIVSS

SEQ ID NO: 1191 - protein, 95 aa, Homo sapiens
EIVMTQSPATLSVSPGEGATLSCRASQSVSSNLAWYQQRPGQAPRLLIYDASTRATGVPARFSGSGSGTEFTLTISSLQSEDFAVYYCQQYNEWP

SEQ ID NO: 1192 - protein, 26 aa, Homo sapiens
EIVMTQSPATLSVSPGEGATLSCRAS

SEQ ID NO: 1193 - protein, 6 aa, Homo sapiens
QSVSSN

SEQ ID NO: 1194 - protein, 17 aa, Homo sapiens
LAWYQQRPGQAPRLLIY

SEQ ID NO: 1195 - skipped

SEQ ID NO: 1196 - protein, 36 aa, Homo sapiens
TRATGVPARFSGSGSGTEFTLTISSLQSEDFAVYYC

SEQ ID NO: 1197 - protein, 11 aa, Homo sapiens
QQYNEWPPMYT

SEQ ID NO: 1198 - DNA, 415 bp, Homo sapiens
gaaatagtgatgacgcagtctccagccaccctgtctgtgtctccaggggaaggagccaccctctcctgcagggccagtcagagtgttagcagcaacttagcctggtatcagcagagacctggccaggctcccaggctcctcatctatgatgcatccaccagggccactggtgtcccagccaggttcagtggcagtgggtctgggacagagttcactctcaccatcagcagcctgcagtctgaagattttgcagtttattactgtcagcagtataatgagtggcctcctatgtacacttttggccaggggaccaagctggagatcaaacgaactgtggctgcaccatctgtcttcatcttcccgccatctgatgagcagttgaaatctggaactgcctctgttgtgtgcctgctga

SEQ ID NO: 1199 - protein, 109 aa, Homo sapiens
EIVMTQSPATLSVSPGEGATLSCRASQSVSSNLAWYQQRPGQAPRLLIYDASTRATGVPARFSGSGSGTEFTLTISSLQSEDFAVYYCQQYNEWPPMYTFGQGTKLEIK

SEQ ID NO: 1200 - protein, 10 aa, Homo sapiens
FGQGTKLEIK

SEQ ID NO: 1201 - protein, 97 aa, Homo sapiens
QVQLVESGGGVVQPGRSLRLSCAASGFSFSNYGIHWVRQAQGKGLEWVAVISHTGSNKYYADSVKGRFTISRDNSKNMLYLQMNSLRVEDTAVYYCA

SEQ ID NO: 1202 - protein, 25 aa, Homo sapiens
QVQLVESGGGVVQPGRSLRLSCAAS

SEQ ID NO: 1203 - protein, 8 aa, Homo sapiens
GFSFSNYG

SEQ ID NO: 1204 - protein, 17 aa, Homo sapiens
IHWVRQAQGKGLEWVAV

SEQ ID NO: 1205 - protein, 8 aa, Homo sapiens
ISHTGSNK

SEQ ID NO: 1206 - protein, 38 aa, Homo sapiens
YYADSVKGRFTISRDNSKNMLYLQMNSLRVEDTAVYYC

SEQ ID NO: 1207 - protein, 23 aa, Homo sapiens
ATLGGDIVLEPGTRSDYYYGLDV

SEQ ID NO: 1208 - DNA, 415 bp, Homo sapiens
caggtgcagctggtggagtctgggggaggcgtggtccagcctgggaggtccctgagactctcctgtgcagcctctggattcagtttcagtaattatggcatacactgggtccgccaggctcaaggcaaggggctggagtgggtggcagttatatcacacactggaagtaataaatattatgcagactccgtgaagggccgattcaccatctccagagacaattccaagaacatgttgtatctgcaaatgaacagcctgagagttgaggacacggctgtgtattactgtgcgacactgggtggggacattgttctagaaccaggtactaggtcggactactactacggtttggacgtctggggccaagggaccacggtcaccgtctcctcagcatccccgaccagccccaaggtct

SEQ ID NO: 1209 - protein, 130 aa, Homo sapiens
QVQLVESGGGVVQPGRSLRLSCAASGFSFSNYGIHWVRQAQGKGLEWVAVISHTGSNKYYADSVKGRFTISRDNSKNMLYLQMNSLRVEDTAVYYCATLGGDIVLEPGTRSDYYYGLDVWGQGTTVTVSS

SEQ ID NO: 1210 - protein, 11 aa, Homo sapiens
WGQGTTVTVSS

SEQ ID NO: 1211 - protein, 95 aa, Homo sapiens
DIQMTQSPSTLSASVGDRVTITCRASQSISTWLAWYQQKPGKAPNLLIYKASSLKSGVPSRFSGSGSGTDFTLTISSLQPDDFATYYCQQYYTNS

SEQ ID NO: 1212 - protein, 26 aa, Homo sapiens
DIQMTQSPSTLSASVGDRVTITCRAS

SEQ ID NO: 1213 - protein, 6 aa, Homo sapiens
QSISTW

SEQ ID NO: 1214 - protein, 17 aa, Homo sapiens
LAWYQQKPGKAPNLLIY

SEQ ID NO: 1215 - skipped

SEQ ID NO: 1216 - protein, 36 aa, Homo sapiens
SLKSGVPSRFSGSGSGTDFTLTISSLQPDDFATYYC

SEQ ID NO: 1217 - protein, 9 aa, Homo sapiens
QQYYTNSRM

SEQ ID NO: 1218 - DNA, 498 bp, Homo sapiens
  modified_base (36)..(36): a, c, t, g, unknown or other
  misc_feature (36)..(36): n is a, c, g, or t
gacatccagatgacccagtctccttccaccctgtcngcatctgtaggggacagagtcaccatcacttgccgggccagtcagagtattagtacctggttggcctggtatcagcagaaaccagggaaagcccctaacctcctgatctataaggcgtccagtttaaaaagtggggtcccatcacgtttcagcggcagtggatctgggacagacttcactctcaccatcagcagcctgcagcctgatgattttgcaacttattactgccaacaatattatactaattctaggatgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcag

SEQ ID NO: 1219 - protein, 107 aa, Homo sapiens
DIQMTQSPSTLSASVGDRVTITCRASQSISTWLAWYQQKPGKAPNLLIYKASSLKSGVPSRFSGSGSGTDFTLTISSLQPDDFATYYCQQYYTNSRMFGQGTKVEIK

SEQ ID NO: 1220 - protein, 10 aa, Homo sapiens
FGQGTKVEIK

SEQ ID NO: 1221 - protein, 98 aa, Homo sapiens
QVQLVESGGGLVKPGGSLRLSCAASGFNFSDYYMSWIRQAPGKRLEWVSYISSSGDNTLYADSMRGRFTISRDNAKKSLYLQLSSLRAEDTAVFYCAR

SEQ ID NO: 1222 - protein, 25 aa, Homo sapiens
QVQLVESGGGLVKPGGSLRLSCAAS

SEQ ID NO: 1223 - protein, 8 aa, Homo sapiens
GFNFSDYY

SEQ ID NO: 1224 - protein, 17 aa, Homo sapiens
MSWIRQAPGKRLEWVSY

SEQ ID NO: 1225 - protein, 8 aa, Homo sapiens
ISSSGDNT

SEQ ID NO: 1226 - protein, 38 aa, Homo sapiens
LYADSMRGRFTISRDNAKKSLYLQLSSLRAEDTAVFYC

SEQ ID NO: 1227 - protein, 19 aa, Homo sapiens
ARASAYYYDSSGRAAAFDI

SEQ ID NO: 1228 - DNA, 415 bp, Homo sapiens
caggtgcagctggtggagtctgggggaggcttggtcaagcctggagggtccctgagactctcgtgtgcagcctctggattcaacttcagtgactactacatgagctggatccgccaggctccagggaagcggctggagtgggtttcatacattagcagtagtggtgataacacactctacgcagactctatgaggggccgtttcaccatctccagggacaacgccaagaagtcactgtatttgcaattgagcagcctgagagccgaggacacggccgtgttttactgtgcgagagcctccgcgtattattatgatagtagtggccgggcggctgcttttgatatctggggccaagggacaagggtcaccgtctcttcagcctccaccaagggcccatcggtcttccccctggcac

SEQ ID NO: 1229 - protein, 126 aa, Homo sapiens
QVQLVESGGGLVKPGGSLRLSCAASGFNFSDYYMSWIRQAPGKRLEWVSYISSSGDNTLYADSMRGRFTISRDNAKKSLYLQLSSLRAEDTAVFYCARASAYYYDSSGRAAAFDIWGQGTRVTVSS

SEQ ID NO: 1230 - protein, 11 aa, Homo sapiens
WGQGTRVTVSS

SEQ ID NO: 1231 - protein, 100 aa, Homo sapiens
DIVMTQSPLSLPVTPGEPASISCRSSQSLLHSNGYNYLEWYVQKPGQSPQLLIYLGSNRASGVPDRFSGSGSGRDFTLKISRVEAEDVGVYYCMQVLQTP

SEQ ID NO: 1232 - protein, 26 aa, Homo sapiens
DIVMTQSPLSLPVTPGEPASISCRSS

SEQ ID NO: 1233 - protein, 11 aa, Homo sapiens
QSLLHSNGYNY

SEQ ID NO: 1234 - protein, 17 aa, Homo sapiens
LEWYVQKPGQSPQLLIY

SEQ ID NO: 1235 - skipped

SEQ ID NO: 1236 - protein, 36 aa, Homo sapiens
NRASGVPDRFSGSGSGRDFTLKISRVEAEDVGVYYC

SEQ ID NO: 1237 - protein, 10 aa, Homo sapiens
MQVLQTPLFT

SEQ ID NO: 1238 - DNA, 498 bp, Homo sapiens
gatattgtgatgactcagtctccactctccctgcccgtcacccctggagagccggcctccatctcctgcaggtctagtcagagcctcctgcatagtaatggatacaactatttggagtggtacgtgcagaagccaggacagtctccacagctcctgatctatttgggttctaatcgggcctccggggtccctgacaggttcagtggcagtggatcaggcagagattttacactgaaaatcagcagagtggaggctgaggatgtaggggtttattactgcatgcaagttctacaaactcctctattcactttcggccctgggaccaaagtggatatcaaacgaactgtggctgcaccatctgtctccatcttcccgccatctgatgagcagttgaaatctggaactgcctctgttgtgtgcctgctgaataacttctatcccagagaggccaaagtacagtggaaggtggataacgccctccaatcgggtaactcccag

SEQ ID NO: 1239 - protein, 113 aa, Homo sapiens
DIVMTQSPLSLPVTPGEPASISCRSSQSLLHSNGYNYLEWYVQKPGQSPQLLIYLGSNRASGVPDRFSGSGSGRDFTLKISRVEAEDVGVYYCMQVLQTPLFTFGPGTKVDIK

SEQ ID NO: 1240 - protein, 10 aa, Homo sapiens
FGPGTKVDIK

SEQ ID NO: 1241 - protein, 99 aa, Homo sapiens
QVQLQESGPGLVKPSQILSLSCNVSGGSISSGSYYWSWIRQPAGKGLEWIGRLYTSGTTNYNPSLKSRVTMSVDTSKNQFSLKLSSVTAADTAVYYCAR

SEQ ID NO: 1242 - protein, 25 aa, Homo sapiens
QVQLQESGPGLVKPSQILSLSCNVS

SEQ ID NO: 1243 - protein, 10 aa, Homo sapiens
GGSISSGSYY

SEQ ID NO: 1244 - protein, 17 aa, Homo sapiens
WSWIRQPAGKGLEWIGR

SEQ ID NO: 1245 - protein, 7 aa, Homo sapiens
LYTSGTT

SEQ ID NO: 1246 - protein, 38 aa, Homo sapiens
NYNPSLKSRVTMSVDTSKNQFSLKLSSVTAADTAVYYC

SEQ ID NO: 1247 - protein, 17 aa, Homo sapiens
ARGIKGDYGGGANWFDP

SEQ ID NO: 1248 - DNA, 321 bp, Homo sapiens
acatccagatgacccagtctccatctgccatgtctgcatctgtaggagacagagtcaccatcacttgtcgggcgagtcagggcattagcaattatttagcctggtttcagcagaaaccagggaaagtccctaagcgcctgatctattctgcatccactttgcaaagtggggtcccatcaaggttcagcggcagtggatctgggacagaattcactctcacaatcagcagcctgcagcctgaagattttgcaacttattactgtctacagcataatagttaccctctcactttcggcggagggaccaaggtggaaatcaaac

SEQ ID NO: 1249 - protein, 125 aa, Homo sapiens
QVQLQESGPGLVKPSQILSLSCNVSGGSISSGSYYWSWIRQPAGKGLEWIGRLYTSGTTNYNPSLKSRVTMSVDTSKNQFSLKLSSVTAADTAVYYCARGIKGDYGGGANWFDPWGQGTLVTVSS

SEQ ID NO: 1250 - protein, 11 aa, Homo sapiens
WGQGTLVTVSS

SEQ ID NO: 1251 - protein, 95 aa, Homo sapiens
EIVMTQSPATLSVSPGERATLSCRASQSVSSNLAWYQQKPGQAPRLLIYRASTRATGIPARFSGSGSGTEFTLTISSLQSEDFAVYYCQQYNNWP

SEQ ID NO: 1252 - protein, 26 aa, Homo sapiens
EIVMTQSPATLSVSPGERATLSCRAS

SEQ ID NO: 1253 - protein, 6 aa, Homo sapiens
QSVSSN

SEQ ID NO: 1254 - protein, 17 aa, Homo sapiens
LAWYQQKPGQAPRLLIY

SEQ ID NO: 1255 - skipped

SEQ ID NO: 1256 - protein, 36 aa, Homo sapiens; identical to SEQ ID NO: 1156

SEQ ID NO: 1257 - protein, 10 aa, Homo sapiens
QQYNNWPPYT

SEQ ID NO: 1258 - DNA, 361 bp, Homo sapiens
caggtgcagctgcaggagtcgggcccaggactggtgaagccttcggagaccctgtccctcacctgcactgtctctacttactccatcagcagtggttactactggggctggatccggcagcccccagggaaggggctggagtggattggaagtatctatcatagtgggaccacctactacaacccgtccctcaagagtcgaatcaccacatcagtagacacgtccaagaaccagttctccctgaaactgacctctgtgaccgccgcagacacggccgtgtattattgtgcgaggtatatagtgtctacgatcaactactttgacgactggggccagggaaccctggtcaccgtctcctcag

SEQ ID NO: 1259 - protein, 108 aa, Homo sapiens
EIVMTQSPATLSVSPGERATLSCRASQSVSSNLAWYQQKPGQAPRLLIYRASTRATGIPARFSGSGSGTEFTLTISSLQSEDFAVYYCQQYNNWPPYTFGQGTKVEIK

SEQ ID NO: 1260 - protein, 10 aa, Homo sapiens
FGQGTKVEIK

SEQ ID NO: 1261 - protein, 98 aa, Homo sapiens
QVQLQESGPGLVKPSQTLSLTCTVSGGSISSGNYYWSWIRQPAGKGLEWIGRIYTSGSTNYNPSLKSRITMSVDMSKNQFSLKLSSLTAADTAVYYCA

SEQ ID NO: 1262 - protein, 25 aa, Homo sapiens
QVQLQESGPGLVKPSQTLSLTCTVS

SEQ ID NO: 1263 - protein, 10 aa, Homo sapiens
GGSISSGNYY

SEQ ID NO: 1264 - protein, 17 aa, Homo sapiens
WSWIRQPAGKGLEWIGR

SEQ ID NO: 1265 - protein, 7 aa, Homo sapiens
IYTSGST

SEQ ID NO: 1266 - protein, 38 aa, Homo sapiens
NYNPSLKSRITMSVDMSKNQFSLKLSSLTAADTAVYYC

SEQ ID NO: 1267 - protein, 14 aa, Homo sapiens
ARARFFGISNWFDP

SEQ ID NO: 1268 - DNA, 328 bp, Homo sapiens
gaaattgtgttgacgcagtctccaggcaccctgtctttgtctccaggggaaagagccaccctctcctgcagggccagtcagagtgtgaacagcatctacttagcctggtaccagcagaaacctggccaggctcccagggtcctcatctatggtacatccagcagggccactggcatcccagacaggttcagtggcagtgggtctgggacagacttcactctcaccattagcagactggagcctgaagattttgcagtgtattactgtcagctgtatggtggctcacctttattcgctttcggccctgggaccaaagtggatatcaaac

SEQ ID NO: 1269 - protein, 122 aa, Homo sapiens
QVQLQESGPGLVKPSQTLSLTCTVSGGSISSGNYYWSWIRQPAGKGLEWIGRIYTSGSTNYNPSLKSRITMSVDMSKNQFSLKLSSLTAADTAVYYCARARFFGISNWFDPWGQGTLVTVSS

SEQ ID NO: 1270 - protein, 11 aa, Homo sapiens
WGQGTLVTVSS

SEQ ID NO: 1271 - protein, 95 aa, Homo sapiens
DIQMTQSPSSLSASVGDRVTITCRASQTISSYLNWYQQKPGKAPKLLIYGASSLQSGVPSRVSGSGSGTDFTLTISSLQPEDFATYYCQQSYSAP

SEQ ID NO: 1272 - protein, 26 aa, Homo sapiens [sequence omitted]

SEQ ID NO: 1273 - protein, 6 aa, Homo sapiens
QTISSY

SEQ ID NO: 1274 - protein, 17 aa, Homo sapiens
LNWYQQKPGKAPKLLIY

SEQ ID NO: 1275 - skipped

SEQ ID NO: 1276 - protein, 36 aa, Homo sapiens
SLQSGVPSRVSGSGSGTDFTLTISSLQPEDFATYYC

SEQ ID NO: 1277 - protein, 9 aa, Homo sapiens
QQSYSAPLT

SEQ ID NO: 1278 - DNA, 361 bp, Homo sapiens
gaggtgcagctgttggagtctgggggaggcttggtacagcctggggggtccctgagactctcctgtgcagcctctggattcacctttagcagctatgccatgagttgggtccgccaggctcaagggaaggggctggagtgggtctcaactattagtgggagtggtggtagcacatactacgcagactccgtgaagggccggttcaccatctccagagacaattctaagaacacgttatatctgcaaatgaacagcctgaaagccgaggacacggccgtatactactgtgcgaaagatccccgtagtagtgtcccctgggtggcctactggggccagggaaccctggtcaccgtctcctcag

SEQ ID NO: 1279 - protein, 107 aa, Homo sapiens
DIQMTQSPSSLSASVGDRVTITCRASQTISSYLNWYQQKPGKAPKLLIYGASSLQSGVPSRVSGSGSGTDFTLTISSLQPEDFATYYCQQSYSAPLTFGQGTKVEIK

SEQ ID NO: 1280 - protein, 10 aa, Homo sapiens
FGQGTKVEIK

SEQ ID NO: 1281 - protein, 97 aa, Homo sapiens
VQLVQSGDEVKKPGSSVRVSCKTSGSTFSTYPISWVRQAPGQGLEWMGGIIPIVGTANYAQKFQDRVAITADQSTSTAYMDLTSLRSEDTAVYYCAR

SEQ ID NO: 1282 - protein, 24 aa, Homo sapiens
VQLVQSGDEVKKPGSSVRVSCKTS

SEQ ID NO: 1283 - protein, 8 aa, Homo sapiens
GSTFSTYP

SEQ ID NO: 1284 - protein, 17 aa, Homo sapiens
ISWVRQAPGQGLEWMGG

SEQ ID NO: 1285 - protein, 8 aa, Homo sapiens
IIPIVGTA

SEQ ID NO: 1286 - protein, 38 aa, Homo sapiens
NYAQKFQDRVAITADQSTSTAYMDLTSLRSEDTAVYYC

SEQ ID NO: 1287 - protein, 15 aa, Homo sapiens
ARVGGALIRSSGSDY

SEQ ID NO: 1288 - DNA, 336 bp, Homo sapiens
ttgtgatgactcagtccccactctccctgcccgtcacccttggacagccggcctccatctcctgcaggtctagtcaaagcctcgtacacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcagggtacacactggcctccgtacacttttggccaggggaccaaggtggagatcaaac

SEQ ID NO: 1289 - protein, 121 aa, Homo sapiens
VQLVQSGDEVKKPGSSVRVSCKTSGSTFSTYPISWVRQAPGQGLEWMGGIIPIVGTANYAQKFQDRVAITADQSTSTAYMDLTSLRSEDTAVYYCARVGGALIRSSGSDYWGQGTLVTVSS

SEQ ID NO: 1290 - protein, 11 aa, Homo sapiens
WGQGTLVTVSS

SEQ ID NO: 1291 - protein, 94 aa, Homo sapiens
IQMTQSPSAMSASVGDRVTITCRASQGISNYLAWFQQKPGKVPKRLIYSASTLQSGVPSRFSGSGSGTEFTLTISSLQPEDFATYYCLQHNSYP

SEQ ID NO: 1292 - protein, 25 aa, Homo sapiens
IQMTQSPSAMSASVGDRVTITCRAS

SEQ ID NO: 1293 - protein, 6 aa, Homo sapiens
QGISNY

SEQ ID NO: 1294 - protein, 17 aa, Homo sapiens
LAWFQQKPGKVPKRLIY

SEQ ID NO: 1295 - skipped

SEQ ID NO: 1296 - protein, 36 aa, Homo sapiens
TLQSGVPSRFSGSGSGTEFTLTISSLQPEDFATYYC

SEQ ID NO: 1297 - protein, 9 aa, Homo sapiens
LQHNSYPLT

SEQ ID NO: 1298 - DNA, 361 bp, Homo sapiens
gaggtgcagctgttggagtctgggggaggcttggtacagccaggggggtccctgagactctcctgtgcagcctctggattcacatttagcaactatgccatgagctgggtccgccaggctccagggaaggggctggagtgggtctcaggtattagtgctggtggtagtaacaaatactacgcagactccgtgaagggccggttcaccgtctccagagacaattccaagaacacgctgtttctgcaaatgaacagcctgagagtcgaggacacggccgtatattattgtgcgaatcggatgggactacggccggactactttgactactggggccagggaaccctggtcaccgtctcctcag

SEQ ID NO: 1299 - protein, 106 aa, Homo sapiens
IQMTQSPSAMSASVGDRVTITCRASQGISNYLAWFQQKPGKVPKRLIYSASTLQSGVPSRFSGSGSGTEFTLTISSLQPEDFATYYCLQHNSYPLTFGGGTKVEIK

SEQ ID NO: 1300 - protein, 10 aa, Homo sapiens
FGGGTKVEIK

SEQ ID NO: 1301 - protein, 97 aa, Homo sapiens
QVQLQESGPGLVKPSETLSLTCTVSTYSISSGYYWGWIRQPPGKGLEWIGSIYHSGTTYYNPSLKSRITTSVDTSKNQFSLKLTSVTAADTAVYYCA

SEQ ID NO: 1302 - protein, 25 aa, Homo sapiens
QVQLQESGPGLVKPSETLSLTCTVS

SEQ ID NO: 1303 - protein, 9 aa, Homo sapiens
TYSISSGYY

SEQ ID NO: 1304 - protein, 17 aa, Homo sapiens
WGWIRQPPGKGLEWIGS

SEQ ID NO: 1305 - protein, 7 aa, Homo sapiens
IYHSGTT

SEQ ID NO: 1306 - protein, 38 aa, Homo sapiens
YYNPSLKSRITTSVDTSKNQFSLKLTSVTAADTAVYYC

SEQ ID NO: 1307 - protein, 13 aa, Homo sapiens
ARYIVSTINYFDD

SEQ ID NO: 1308 - DNA, 325 bp, Homo sapiens
gaaattgtgttgacgcagtctccaggcaccctgtctttgtctccaggggaaagagccaccctctcctgcagggccagtcagagtgttagcagcagctccttagcctggtaccagcagaaacctggccaggctcccaggctcctcatctatgatgcatccagcagggccactggcatcccagacaggttcagtggcagtgggtctgggacagacttcactctcaccatcagcagactggagcctgaggattttgcagtgtattactgtcagcagtatggtacctcagctaaaacttttggccaggggaccaaggtggagatcaaac

SEQ ID NO: 1309 - protein, 120 aa, Homo sapiens
QVQLQESGPGLVKPSETLSLTCTVSTYSISSGYYWGWIRQPPGKGLEWIGSIYHSGTTYYNPSLKSRITTSVDTSKNQFSLKLTSVTAADTAVYYCARYIVSTINYFDDWGQGTLVTVSS

SEQ ID NO: 1310 - protein, 11 aa, Homo sapiens
WGQGTLVTVSS

SEQ ID NO: 1311 - protein, 96 aa, Homo sapiens
EIVLTQSPGTLSLSPGERATLSCRASQSVNSIYLAWYQQKPGQAPRVLIYGTSSRATGIPDRFSGSGSGTDFTLTISRLEPEDFAVYYCQLYGGSP

SEQ ID NO: 1312 - protein, 26 aa, Homo sapiens [sequence omitted]

SEQ ID NO: 1313 - protein, 7 aa, Homo sapiens
QSVNSIY

SEQ ID NO: 1314 - protein, 17 aa, Homo sapiens
LAWYQQKPGQAPRVLIY

SEQ ID NO: 1315 - skipped

SEQ ID NO: 1316 - protein, 36 aa, Homo sapiens [sequence omitted]

SEQ ID NO: 1317 - protein, 10 aa, Homo sapiens
QLYGGSPLFA

SEQ ID NO: 1318 - DNA, 358 bp, Homo sapiens
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagctattagtggtagtggtggtagcacataccacgcagactccgtgaagggccggttcaccatttccagagacaattccaagaacacgctgtatctgcaaatgagcagcctgagagccgaggacacggccgtatattactgtgcgaaatccccggcgagcagctggtactttgaccactggggccagggaaccctggtcaccgtctcctcag

SEQ ID NO: 1319 - protein, 109 aa, Homo sapiens
EIVLTQSPGTLSLSPGERATLSCRASQSVNSIYLAWYQQKPGQAPRVLIYGTSSRATGIPDRFSGSGSGTDFTLTISRLEPEDFAVYYCQLYGGSPLFAFGPGTKVDIK

SEQ ID NO: 1320 - protein, 10 aa, Homo sapiens
FGPGTKVDIK

SEQ ID NO: 1321 - protein, 98 aa, Homo sapiens
EVQLLESGGGLVQPGGSLRLSCAASGFTFSSYAMSWVRQAQGKGLEWVSTISGSGGSTYYADSVKGRFTISRDNSKNTLYLQMNSLKAEDTAVYYCAK

SEQ ID NO: 1322 - protein, 25 aa, Homo sapiens
EVQLLESGGGLVQPGGSLRLSCAAS

SEQ ID NO: 1323 - protein, 8 aa, Homo sapiens
GFTFSSYA

SEQ ID NO: 1324 - protein, 17 aa, Homo sapiens
MSWVRQAQGKGLEWVST

SEQ ID NO: 1325 - protein, 8 aa, Homo sapiens
ISGSGGST

SEQ ID NO: 1326 - protein, 38 aa, Homo sapiens
YYADSVKGRFTISRDNSKNTLYLQMNSLKAEDTAVYYC

SEQ ID NO: 1327 - protein, 13 aa, Homo sapiens
AKDPRSSVPWVAY

SEQ ID NO: 1328 - DNA, 325 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcgtcatctatggtgcatccaccagggccactggtatcccagccaggttcagtggcagtgggtctgggacagagttcactctcaccatcagcagcctgcagtctgaagattttgcagtttattactgtcagcaagataataactggcccacgtggacgttcggccaagggaccaaggtggaaatcaaac

SEQ ID NO: 1329 - protein, 120 aa, Homo sapiens
EVQLLESGGGLVQPGGSLRLSCAASGFTFSSYAMSWVRQAQGKGLEWVSTISGSGGSTYYADSVKGRFTISRDNSKNTLYLQMNSLKAEDTAVYYCAKDPRSSVPWVAYWGQGTLVTVSS

SEQ ID NO: 1330 - protein, 11 aa, Homo sapiens
WGQGTLVTVSS

SEQ ID NO: 1331 - protein, 98 aa, Homo sapiens
VMTQSPLSLPVTLGQPASISCRSSQSLVHSDGNTYLNWFQQRPGQSPRRLIYKVSNRDSGVPDRFSGSGSGTDFTLKISRVEAEDVGVYYCMQGTHWP

SEQ ID NO: 1332 - protein, 24 aa, Homo sapiens
VMTQSPLSLPVTLGQPASISCRSS

SEQ ID NO: 1333 - protein, 11 aa, Homo sapiens
QSLVHSDGNTY

SEQ ID NO: 1334 - protein, 17 aa, Homo sapiens
LNWFQQRPGQSPRRLIY

SEQ ID NO: 1335 - skipped

SEQ ID NO: 1336 - protein, 36 aa, Homo sapiens; identical to SEQ ID NO: 256

SEQ ID NO: 1337 - protein, 10 aa, Homo sapiens
MQGTHWPPYT

SEQ ID NO: 1338 - DNA, 360 bp, Homo sapiens
gaggtgcagctgttggagtctgggggaggcttggtacagcctggggggtccctgagactctcctgtgcagcctctggattcacatctaatagctttgtcatgaattgggtccgccaggctccagggaaggggctggagtgggtctcggctattaagggtactgtaaatagtacattctacgcagattccgtgaagggccgcttcaccatctccagagacaattctaagaacacggtgtatctgcaaatgagcagcctgagagtcgaggacacggccatttattactgccgcgggtggttcggggagggaatcaacggttgggacgtctggggccaagggaccacggtcaccgtctcctca

SEQ ID NO: 1339 - protein, 111 aa, Homo sapiens
VMTQSPLSLPVTLGQPASISCRSSQSLVHSDGNTYLNWFQQRPGQSPRRLIYKVSNRDSGVPDRFSGSGSGTDFTLKISRVEAEDVGVYYCMQGTHWPPYTFGQGTKVEIK

SEQ ID NO: 1340 - protein, 10 aa, Homo sapiens
FGQGTKVEIK

SEQ ID NO: 1341 - protein, 97 aa, Homo sapiens
EVQLLESGGGLVQPGGSLRLSCAASGFTFSNYAMSWVRQAPGKGLEWVSGISAGGSNKYYADSVKGRFTVSRDNSKNTLFLQMNSLRVEDTAVYYCA

SEQ ID NO: 1342 - protein, 25 aa, Homo sapiens
EVQLLESGGGLVQPGGSLRLSCAAS

SEQ ID NO: 1343 - protein, 8 aa, Homo sapiens
GFTFSNYA

SEQ ID NO: 1344 - protein, 17 aa, Homo sapiens
MSWVRQAPGKGLEWVSG

SEQ ID NO: 1345 - protein, 8 aa, Homo sapiens
ISAGGSNK

SEQ ID NO: 1346 - protein, 38 aa, Homo sapiens
YYADSVKGRFTVSRDNSKNTLFLQMNSLRVEDTAVYYC

SEQ ID NO: 1347 - protein, 13 aa, Homo sapiens
ANRMGLRPDYFDY

SEQ ID NO: 1348 - DNA, 337 bp, Homo sapiens
gatattgtgatgactcagtctccgctctccctgcccgtcacccctggagcgccggcctccatctcctgcagatccagtcggagcctcctgcatagagatggatacaactatgtagattggtacctgcagaagccagggcagtctccacagctcctgatctatttgggttctaatcgggcctccggggtccctgacaggttcagtggcagtggatcaggcacagatttcacactgaaaatgagcagagtggaggctgaggatgttggggtttattactgcatgcaagctctacaaactccgtacaattttggccaggggaccaaggtggagatcaaac

SEQ ID NO: 1349 - protein, 120 aa, Homo sapiens
EVQLLESGGGLVQPGGSLRLSCAASGFTFSNYAMSWVRQAPGKGLEWVSGISAGGSNKYYADSVKGRFTVSRDNSKNTLFLQMNSLRVEDTAVYYCANRMGLRPDYFDYWGQGTLVTVSS

SEQ ID NO: 1350 - protein, 11 aa, Homo sapiens
WGQGTLVTVSS

SEQ ID NO: 1351 - protein, 96 aa, Homo sapiens
EIVLTQSPGTLSLSPGERATLSCRASQSVSSSSLAWYQQKPGQAPRLLIYDASSRATGIPDRFSGSGSGTDFTLTISRLEPEDFAVYYCQQYGTSA

SEQ ID NO: 1352 - protein, 26 aa, Homo sapiens [sequence omitted]

SEQ ID NO: 1353 - protein, 7 aa, Homo sapiens
QSVSSSS

SEQ ID NO: 1354 - protein, 17 aa, Homo sapiens
LAWYQQKPGQAPRLLIY

SEQ ID NO: 1355 - skipped

SEQ ID NO: 1356 - protein, 36 aa, Homo sapiens [sequence omitted]

SEQ ID NO: 1357 - protein, 9 aa, Homo sapiens
QQYGTSAKT

SEQ ID NO: 1358 - DNA, 321 bp, Homo sapiens; identical to SEQ ID NO: 1248

SEQ ID NO: 1359 - protein, 108 aa, Homo sapiens
EIVLTQSPGTLSLSPGERATLSCRASQSVSSSSLAWYQQKPGQAPRLLIYDASSRATGIPDRFSGSGSGTDFTLTISRLEPEDFAVYYCQQYGTSAKTFGQGTKVEIK

SEQ ID NO: 1360 - protein, 10 aa, Homo sapiens
FGQGTKVEIK

SEQ ID NO: 1361 - protein, 98 aa, Homo sapiens
EVQLLESGGGLVQPGGSLRLSCAASGFTFSSYAMNWVRQAPGKGLEWVSAISGSGGSTYHADSVKGRFTISRDNSKNTLYLQMSSLRAEDTAVYYCAK

SEQ ID NO: 1362 - protein, 25 aa, Homo sapiens
EVQLLESGGGLVQPGGSLRLSCAAS

SEQ ID NO: 1363 - protein, 8 aa, Homo sapiens
GFTFSSYA

SEQ ID NO: 1364 - protein, 17 aa, Homo sapiens
MNWVRQAPGKGLEWVSA

SEQ ID NO: 1365 - protein, 8 aa, Homo sapiens
ISGSGGST

SEQ ID NO: 1366 - protein, 38 aa, Homo sapiens
YHADSVKGRFTISRDNSKNTLYLQMSSLRAEDTAVYYC

SEQ ID NO: 1367 - protein, 12 aa, Homo sapiens
AKSPASSWYFDH

SEQ ID NO: 1368 - DNA, 361 bp, Homo sapiens; identical to SEQ ID NO: 1258

SEQ ID NO: 1369 - protein, 119 aa, Homo sapiens
EVQLLESGGGLVQPGGSLRLSCAASGFTFSSYAMNWVRQAPGKGLEWVSAISGSGGSTYHADSVKGRFTISRDNSKNTLYLQMSSLRAEDTAVYYCAKSPASSWYFDHWGQGTLVTVSS

SEQ ID NO: 1370 - protein, 11 aa, Homo sapiens
WGQGTLVTVSS

SEQ ID NO: 1371 - protein, 94 aa, Homo sapiens
EIVMTQSPATLSVSPGERATLSCRASQSVSSNLAWYQQKPGQAPRLVIYGASTRATGIPARFSGSGSGTEFTLTISSLQSEDFAVYYCQQDNNW

SEQ ID NO: 1372 - protein, 26 aa, Homo sapiens
EIVMTQSPATLSVSPGERATLSCRAS

SEQ ID NO: 1373 - protein, 6 aa, Homo sapiens
QSVSSN

SEQ ID NO: 1374 - protein, 17 aa, Homo sapiens
LAWYQQKPGQAPRLVIY

SEQ ID NO: 1375 - skipped

SEQ ID NO: 1376 - protein, 36 aa, Homo sapiens; identical to SEQ ID NO: 1156

SEQ ID NO: 1377 - protein, 10 aa, Homo sapiens
QQDNNWPTWT

SEQ ID NO: 1378 - DNA, 328 bp, Homo sapiens; identical to SEQ ID NO: 1268

SEQ ID NO: 1379 - protein, 108 aa, Homo sapiens
EIVMTQSPATLSVSPGERATLSCRASQSVSSNLAWYQQKPGQAPRLVIYGASTRATGIPARFSGSGSGTEFTLTISSLQSEDFAVYYCQQDNNWPTWTFGQGTKVEIK

SEQ ID NO: 1380 - protein, 10 aa, Homo sapiens
FGQGTKVEIK

SEQ ID NO: 1381 - protein, 95 aa, Homo sapiens
EVQLLESGGGLVQPGGSLRLSCAASGFTSNSFVMNWVRQAPGKGLEWVSAIKGTVNSTFYADSVKGRFTISRDNSKNTVYLQMSSLRVEDTAIYY

SEQ ID NO: 1382 - protein, 25 aa, Homo sapiens
EVQLLESGGGLVQPGGSLRLSCAAS

SEQ ID NO: 1383 - protein, 8 aa, Homo sapiens
GFTSNSFV

SEQ ID NO: 1384 - protein, 17 aa, Homo sapiens
MNWVRQAPGKGLEWVSA

SEQ ID NO: 1385 - protein, 8 aa, Homo sapiens
IKGTVNST

SEQ ID NO: 1386 - protein, 38 aa, Homo sapiens
FYADSVKGRFTISRDNSKNTVYLQMSSLRVEDTAIYYC

SEQ ID NO: 1387 - protein, 13 aa, Homo sapiens
RGWFGEGINGWDV

SEQ ID NO: 1388 - DNA, 361 bp, Homo sapiens; identical to SEQ ID NO: 1278

SEQ ID NO: 1389 - protein, 120 aa, Homo sapiens
EVQLLESGGGLVQPGGSLRLSCAASGFTSNSFVMNWVRQAPGKGLEWVSAIKGTVNSTFYADSVKGRFTISRDNSKNTVYLQMSSLRVEDTAIYYCRGWFGEGINGWDVWGQGTTVTVSS

SEQ ID NO: 1390 - protein, 11 aa, Homo sapiens
WGQGTTVTVSS

SEQ ID NO: 1391 - protein, 99 aa, Homo sapiens
DIVMTQSPLSLPVTPGAPASISCRSSRSLLHRDGYNYVDWYLQKPGQSPQLLIYLGSNRASGVPDRFSGSGSGTDFTLKMSRVEAEDVGVYYCMQALQT

SEQ ID NO: 1392 - protein, 26 aa, Homo sapiens
DIVMTQSPLSLPVTPGAPASISCRSS

SEQ ID NO: 1393 - protein, 11 aa, Homo sapiens
RSLLHRDGYNY

SEQ ID NO: 1394 - protein, 17 aa, Homo sapiens
VDWYLQKPGQSPQLLIY

SEQ ID NO: 1395 - skipped

SEQ ID NO: 1396 - protein, 36 aa, Homo sapiens
NRASGVPDRFSGSGSGTDFTLKMSRVEAEDVGVYYC

SEQ ID NO: 1397 - protein, 9 aa, Homo sapiens
MQALQTPYN

SEQ ID NO: 1398 - DNA, 336 bp, Homo sapiens; identical to SEQ ID NO: 1288

SEQ ID NO: 1399 - protein, 112 aa, Homo sapiens
DIVMTQSPLSLPVTPGAPASISCRSSRSLLHRDGYNYVDWYLQKPGQSPQLLIYLGSNRASGVPDRFSGSGSGTDFTLKMSRVEAEDVGVYYCMQALQTPYNFGQGTKVEIK

SEQ ID NO: 1400 - protein, 10 aa, Homo sapiens
FGQGTKVEIK

SEQ ID NO: 1401 - protein, 15 aa, Homo sapiens
CAGGSDDHAWGSFYW

SEQ ID NO: 1402 - protein, 11 aa, Homo sapiens
CMQRIAFPFTF

SEQ ID NO: 1403 - protein, 18 aa, Homo sapiens
CARGLEGITVGAYYFDFW

SEQ ID NO: 1404 - protein, 11 aa, Homo sapiens [sequence omitted]

SEQ ID NO: 1405 - protein, 17 aa, Homo sapiens
CARDRRDLLTGSLGDYW

SEQ ID NO: 1406 - protein, 11 aa, Homo sapiens [sequence omitted]

SEQ ID NO: 1407 - protein, 15 aa, Homo sapiens
CASPAYNSGFALLHW

SEQ ID NO: 1408 - protein, 12 aa, Homo sapiens
CQQYYSNSMYTF

SEQ ID NO: 1409 - protein, 20 aa, Homo sapiens
CASPDLTMVFVPHTGPLDFW

SEQ ID NO: 1410 - protein, 11 aa, Homo sapiens
CQHYDTYSGTF

SEQ ID NO: 1411 - protein, 21 aa, Homo sapiens
CARDCSGFEDMDSFYYFMDVW

SEQ ID NO: 1412 - protein, 13 aa, Homo sapiens
CQYRSHWPPAVTF

SEQ ID NO: 1413 - protein, 21 aa, Homo sapiens
CARQLTGMVYAILLPSYFDFW

SEQ ID NO: 1414 - protein, 11 aa, Homo sapiens
CQQHNSYSGAF

SEQ ID NO: 1415 - protein, 17 aa, Homo sapiens
CAKDRILPYDTDAFDIW

SEQ ID NO: 1416 - protein, 12 aa, Homo sapiens
CQEYHTSSRVTF

SEQ ID NO: 1417 - protein, 18 aa, Homo sapiens
CAKDRVVGRPWEYSLDFW

SEQ ID NO: 1418 - protein, 12 aa, Homo sapiens [sequence omitted]

SEQ ID NO: 1419 - protein, 13 aa, Homo sapiens
CASRHYNYDDDYG

SEQ ID NO: 1420 - protein, 10 aa, Homo sapiens [sequence omitted]

SEQ ID NO: 1421 - protein, 20 aa, Homo sapiens
CARAGSYGDYRPINNWFDPW

SEQ ID NO: 1422 - protein, 11 aa, Homo sapiens
CQHYSNYSYTF

SEQ ID NO: 1423 - protein, 17 aa, Homo sapiens
CARDPSNPPHWGNFDSW

SEQ ID NO: 1424 - protein, 12 aa, Homo sapiens [sequence omitted]

SEQ ID NO: 1425 - protein, 18 aa, Homo sapiens
CAKDLAVTPPAQGYLDRW

SEQ ID NO: 1426 - protein, 12 aa, Homo sapiens [sequence omitted]

SEQ ID NO: 1427 - protein, 19 aa, Homo sapiens
CARGIKGDYGGGANWFDPW

SEQ ID NO: 1428 - protein, 12 aa, Homo sapiens [sequence omitted]

SEQ ID NO: 1429 - protein, 16 aa, Homo sapiens
CARARFFGISNWFDPW

SEQ ID NO: 1430 - protein, 11 aa, Homo sapiens [sequence omitted]

SEQ ID NO: 1431 - protein, 17 aa, Homo sapiens
CARVGGALIRSSGSDYW

SEQ ID NO: 1432 - protein, 11 aa, Homo sapiens [sequence omitted]

SEQ ID NO: 1433 - protein, 19 aa, Homo sapiens
CARDDYMTVDRDYYYMDVW

SEQ ID NO: 1434 - protein, 13 aa, Homo sapiens [sequence omitted]

SEQ ID NO: 1435 - protein, 24 aa, Homo sapiens
CARVSREEWATVDDPHDYYYMDVW

SEQ ID NO: 1436 - protein, 11 aa, Homo sapiens
CQQNYNPLFTF

SEQ ID NO: 1437 - protein, 24 aa, Homo sapiens
CVRVSREEWATVDDPHDYYYMDVW

SEQ ID NO: 1438 - protein, 11 aa, Homo sapiens
CQQSYNSLFTF

SEQ ID NO: 1439 - protein, 24 aa, Homo sapiens
CARVSREEWATVDDPHDYYYMDVW

SEQ ID NO: 1440 - protein, 11 aa, Homo sapiens
CQQSYNRLFTF

SEQ ID NO: 1441 - protein, 18 aa, Homo sapiens
CARDFDYGDYRGSAFDIW

SEQ ID NO: 1442 - protein, 7 aa, Homo sapiens [sequence omitted]

SEQ ID NO: 1443 - protein, 19 aa, Homo sapiens
CARDIDTGDYRGADVLQMW

SEQ ID NO: 1444 - protein, 7 aa, Homo sapiens [sequence omitted]

SEQ ID NO: 1445 - protein, 24 aa, Homo sapiens
CARVSREEWATVDDPHDYYYMDVW

SEQ ID NO: 1446 - protein, 11 aa, Homo sapiens
CQQSYITLFTF

SEQ ID NO: 1447 - protein, 21 aa, Homo sapiens
CAREEFTDTEMTITQGDFGYW

SEQ ID NO: 1448 - protein, 11 aa, Homo sapiens
CQRSYITPFTF

SEQ ID NO: 1449 - protein, 19 aa, Homo sapiens
CARDIDSGDYRAADVFQIW

SEQ ID NO: 1450 - protein, 7 aa, Homo sapiens [sequence omitted]

SEQ ID NO: 1451 - protein, 19 aa, Homo sapiens
CARDIDSGDYRAADVFQIW

SEQ ID NO: 1452 - protein, 7 aa, Homo sapiens [sequence omitted]

SEQ ID NO: 1453 - protein, 19 aa, Homo sapiens
CARDIDSGDYRAADVFQIW

SEQ ID NO: 1454 - protein, 7 aa, Homo sapiens [sequence omitted]

SEQ ID NO: 1455 - protein, 24 aa, Homo sapiens
CARVSREEWATVDDPHDYYYMDVW

SEQ ID NO: 1456 - protein, 11 aa, Homo sapiens
CQQSYNSLFTF

SEQ ID NO: 1457 - protein, 26 aa, Homo sapiens
CAREGYDHLWGTYRFEAIDYYYTDVW

SEQ ID NO: 1458 - protein, 11 aa, Homo sapiens
CHQYGSSTGTF

SEQ ID NO: 1459 - protein, 19 aa, Homo sapiens
CARDIDFGDYRAADVFHIW

SEQ ID NO: 1460 - protein, 7 aa, Homo sapiens [sequence omitted]

SEQ ID NO: 1461 - protein, 15 aa, Homo sapiens
CARYIVSTINYFDDW

SEQ ID NO: 1462 - protein, 12 aa, Homo sapiens [sequence omitted]

SEQ ID NO: 1463 - protein, 18 aa, Homo sapiens
CARDFDYGDYRGSAFDIW

SEQ ID NO: 1464 - protein, 7 aa, Homo sapiens [sequence omitted]

SEQ ID NO: 1465 - protein, 21 aa, Homo sapiens
CAREEFTDTEMTINQGDFAYW

SEQ ID NO: 1466 - protein, 11 aa, Homo sapiens
CQRSFITPFTF

SEQ ID NO: 1467 - protein, 18 aa, Homo sapiens
CARDFDYGDYRGSAFDIW

SEQ ID NO: 1468 - protein, 7 aa, Homo sapiens [sequence omitted]

SEQ ID NO: 1469 - protein, 19 aa, Homo sapiens
CTRDSFYDVDLSSFYMDVW

SEQ ID NO: 1470 - protein, 11 aa, Homo sapiens
CQQYGSSRHTF

SEQ ID NO: 1471 - protein, 17 aa, Homo sapiens
CARDRIDYVVYDAFDIW

SEQ ID NO: 1472 - protein, 10 aa, Homo sapiens
CQLYDDFRTF

SEQ ID NO: 1473 - protein, 18 aa, Homo sapiens
CARRGDYGDYRGDAFDIW

SEQ ID NO: 1474 - protein, 7 aa, Homo sapiens
CQQVFTF

SEQ ID NO: 1475 - protein, 27 aa, Homo sapiens
AKDRVRDGDNDWDSVDATYWGYGVFDT

SEQ ID NO: 1476 - protein, 11 aa, Homo sapiens
CQQHYRIPQTF

SEQ ID NO: 1477 - protein, 18 aa, Homo sapiens
CVRDNDYGDYRGNAFDIW

SEQ ID NO: 1478 - protein, 7 aa, Homo sapiens
CEQLHTF

SEQ ID NO: 1479 - protein, 29 aa, Homo sapiens
CARDRVRDGDNYWDSVDATYWGYGAFDIC

SEQ ID NO: 1480 - protein, 11 aa, Homo sapiens
CQQHFTTPQTF

SEQ ID NO: 1481 - protein, 21 aa, Homo sapiens
CARAVSTLVSVDYYFYYIDVW

SEQ ID NO: 1482 - protein, 12 aa, Homo sapiens
CQVWDRNNDPLF

SEQ ID NO: 1483 - protein, 18 aa, Homo sapiens
CARDHDYGDYRGNAYDIW

SEQ ID NO: 1484 - protein, 7 aa, Homo sapiens
CQQLDSF

SEQ ID NO: 1485 - protein, 15 aa, Homo sapiens
CAKDPRSSVPWVAYW

SEQ ID NO: 1486 - protein, 12 aa, Homo sapiens [sequence omitted]

SEQ ID NO: 1487 - protein, 15 aa, Homo sapiens
CANRMGLRPDYFDYW

SEQ ID NO: 1488 - protein, 11 aa, Homo sapiens
CQQYGTSAKTF

SEQ ID NO: 1489 - protein, 14 aa, Homo sapiens
CAKSPASSWYFDHW

SEQ ID NO: 1490 - protein, 12 aa, Homo sapiens
CQQDNNWPTWTF

SEQ ID NO: 1491 - protein, 19 aa, Homo sapiens
CARHRVGTGPEVGDWFDPW

SEQ ID NO: 1492 - protein, 13 aa, Homo sapiens [sequence omitted]

SEQ ID NO: 1493 - protein, 15 aa, Homo sapiens
CRGWFGEGINGWDVW

SEQ ID NO: 1494 - protein, 11 aa, Homo sapiens [sequence omitted]

SEQ ID NO: 1495 - protein, 25 aa, Homo sapiens
CATLGGDIVLEPGTRSDYYYGLDVW

SEQ ID NO: 1496 - protein, 11 aa, Homo sapiens
CQQYYTNSRMF

SEQ ID NO: 1497 - protein, 21 aa, Homo sapiens
CARASAYYYDSSGRAAAFDIW

SEQ ID NO: 1498 - protein, 12 aa, Homo sapiens [sequence omitted]

SEQ ID NO: 1499 - protein, 18 aa, Homo sapiens
CARHVASHWGDYYGMDLW

SEQ ID NO: 1500 - protein, 12 aa, Homo sapiens
CQQYNDWLGGTF

SEQ ID NO: 1501 - protein, 18 aa, Homo sapiens
CARGLEGITVGAYYFDFW

SEQ ID NO: 1502 - protein, 11 aa, Homo sapiens [sequence omitted]

SEQ ID NO: 1503 - protein, 18 aa, Homo sapiens
CARGLEGITVGVYYCDFW

SEQ ID NO: 1504 - protein, 11 aa, Homo sapiens [sequence omitted]

SEQ ID NO: 1505 - protein, 16 aa, Homo sapiens
CARDQELVVLYYFDFW

SEQ ID NO: 1506 - protein, 13 aa, Homo sapiens
CQVYDNSVDHAVF

SEQ ID NO: 1507 - protein, 17 aa, Homo sapiens
CAKEPYRDYLGNWPDPW

SEQ ID NO: 1508 - protein, 11 aa, Homo sapiens
CHQHYTIPPTF

SEQ ID NO: 1509 - protein, 14 aa, Homo sapiens
CARRQVATYWFDPW

SEQ ID NO: 1510 - protein, 13 aa, Homo sapiens
CQVWDSNSGHFVF

SEQ ID NO: 1511 - protein, 15 aa, Homo sapiens
CATSPATSGWWWAYW

SEQ ID NO: 1512 - protein, 11 aa, Homo sapiens
CHQYDIPPQTF

SEQ ID NO: 1513 - protein, 18 aa, Homo sapiens
CARPTPYGTTWFGRVDSW

SEQ ID NO: 1514 - protein, 11 aa, Homo sapiens [sequence omitted]

SEQ ID NO: 1515 - protein, 15 aa, Homo sapiens
CARGDLVSTANFDYW

SEQ ID NO: 1516 - protein, 17 aa, Homo sapiens
CQQYENSQHGSSPPYTF

SEQ ID NO: 1517 - protein, 18 aa, Homo sapiens
CARDHDYGDYRGNAFDMW

SEQ ID NO: 1518 - protein, 7 aa, Homo sapiens
CQQLHTF

SEQ ID NO: 1519 - protein, 17 aa, Homo sapiens
CARLFGELVGYQAFDVW

SEQ ID NO: 1520 - protein, 13 aa, Homo sapiens [sequence omitted]

SEQ ID NO: 1521 - protein, 17 aa, Homo sapiens
CARELGDYPYYYAMDVW

SEQ ID NO: 1522 - protein, 11 aa, Homo sapiens
CQQVITFPRTF

SEQ ID NO: 1523 - protein, 17 aa, Homo sapiens
CARRWFGELDYYGSDVW

SEQ ID NO: 1524 - protein, 11 aa, Homo sapiens
  MOD_RES (8)..(8): Any amino acid
CQTWGTDXQVF

SEQ ID NO: 1525 - protein, 21 aa, Homo sapiens
CARGVSALVSVDYYYYYMDVW

SEQ ID NO: 1526 - protein, 12 aa, Homo sapiens
CQVWDRNIDPHF

SEQ ID NO: 1527 - protein, 21 aa, Homo sapiens
CARGVSALVSVDYYYYYMDVW

SEQ ID NO: 1528 - protein, 12 aa, Homo sapiens
CQVWDRNIDPHF

SEQ ID NO: 1529 - protein, 23 aa, Homo sapiens
VYYCVRADGDSEGFGYHYGMDVW

SEQ ID NO: 1530 - protein, 11 aa, Homo sapiens
CLQHNDYPLTF

SEQ ID NO: 1531 - protein, 15 aa, Homo sapiens
CARAARLYQQAYDIW

SEQ ID NO: 1532 - protein, 12 aa, Homo sapiens
CQQFHSYPLFTF

SEQ ID NO: 1533 - protein, 17 aa, Homo sapiens
CARLFGELVGYQAFDFW

SEQ ID NO: 1534 - protein, 13 aa, Homo sapiens [sequence omitted]

SEQ ID NO: 1535 - protein, 20 aa, Homo sapiens
CAKIFSWQQLDYYYYAMDVW

SEQ ID NO: 1536 - protein, 13 aa, Homo sapiens [sequence omitted]

SEQ ID NO: 1537 - protein, 8 aa, Homo sapiens
CAKDHRGW

SEQ ID NO: 1538 - protein, 11 aa, Homo sapiens
CQQFDKFPWTF

SEQ ID NO: 1539 - protein, 20 aa, Homo sapiens
CARHAKAPDSFGGAEYFDYW

SEQ ID NO: 1540 - protein, 13 aa, Homo sapiens
CQQYNEWPPMYTF

SEQ ID NO: 1541 - protein, 15 aa, Homo sapiens
GGGGSGGGGSGGGGS

We claim:

1. A non-naturally occurring chimeric monoclonal antibody, wherein the monoclonal antibody comprises a heavy chain variable domain and a light chain variable domain,
    wherein the heavy chain variable domain comprising the amino acid sequence set forth as SEQ ID NO: 3, the amino acid sequence set forth as SEQ ID NO: 5, and the amino acid sequence set forth as SEQ ID NO: 7 and the light chain variable domain comprising the amino acid sequence set forth as SEQ ID NO: 13, the amino acid sequence set forth as SEQ ID NO: 15, and the amino acid sequence set forth as SEQ ID NO: 17, and
    wherein the monoclonal antibody specifically binds hemagglutinin (HA) of at least two of H1N1 and H5N1.

2. The non-naturally occurring chimeric monoclonal antibody of claim 1, wherein the monoclonal antibody specifically binds HA of H3N2.

3. The non-naturally occurring chimeric monoclonal antibody of claim 1, wherein the heavy chain variable domain comprises
    an amino acid sequence set forth as SEQ ID NO: 9.

4. The non-naturally occurring chimeric monoclonal antibody of claim 1, wherein the light chain variable domain comprises
    an amino acid sequence set forth as SEQ ID NO: 19.

5. The non-naturally occurring chimeric monoclonal antibody of claim 1, wherein the antibody is an IgG, IgM or IgA.

6. The non-naturally occurring chimeric monoclonal antibody of claim 1, wherein the antibody is labeled.

7. The non-naturally occurring chimeric monoclonal antibody of claim 6, wherein the label is a fluorescent, enzymatic, or radioactive label.

8. A composition comprising the non-naturally occurring chimeric antibody of claim 1 and a pharmaceutically acceptable carrier.

9. A purified nucleic acid molecule encoding the non-naturally occurring chimeric monoclonal antibody of claim 1.

10. The purified nucleic acid molecule of claim 9, comprising a nucleotide sequence set forth as
    SEQ ID NO: 8.

11. An expression vector comprising a nucleic acid comprising SEQ ID NO: 8.

* * * * *